US011464847B2

(12) United States Patent
Jasny et al.

(10) Patent No.: US 11,464,847 B2
(45) Date of Patent: Oct. 11, 2022

(54) LASSA VIRUS VACCINE

(71) Applicant: CureVac AG, Tübingen (DE)

(72) Inventors: Edith Jasny, Stuttgart (DE); Benjamin Petsch, Tübingen (DE)

(73) Assignee: CureVac AG, Tübingen (DE)

( * ) Notice: Subject to any disclaimer, the term of this patent is extended or adjusted under 35 U.S.C. 154(b) by 305 days.

(21) Appl. No.: 16/471,544

(22) PCT Filed: Dec. 22, 2017

(86) PCT No.: PCT/EP2017/084562
§ 371 (c)(1),
(2) Date: Jun. 19, 2019

(87) PCT Pub. No.: WO2018/115525
PCT Pub. Date: Jun. 28, 2018

(65) Prior Publication Data
US 2019/0351044 A1    Nov. 21, 2019

(30) Foreign Application Priority Data
Dec. 23, 2016   (WO) ................ PCT/EP2016/082605

(51) Int. Cl.
*A61K 39/12* (2006.01)
*C07K 14/005* (2006.01)
*C12N 7/00* (2006.01)
*A61P 31/14* (2006.01)
*A61K 39/00* (2006.01)

(52) U.S. Cl.
CPC ............. *A61K 39/12* (2013.01); *A61P 31/14* (2018.01); *C07K 14/005* (2013.01); *C12N 7/00* (2013.01); *A61K 2039/53* (2013.01); *A61K 2039/54* (2013.01); *C12N 2760/10022* (2013.01); *C12N 2760/10034* (2013.01); *C12N 2830/50* (2013.01)

(58) Field of Classification Search
None
See application file for complete search history.

(56) References Cited

U.S. PATENT DOCUMENTS

| | | |
|---|---|---|
| 2005/0032730 A1 | 2/2005 | von der Mülbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0219576 A1* | 8/2012 | Branco ............... C07K 14/005 424/186.1 |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1* | 2/2015 | Thess ..................... C12N 15/85 424/185.1 |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |

(Continued)

FOREIGN PATENT DOCUMENTS

| | | |
|---|---|---|
| WO | WO 2007/093449 | 8/2007 |
| WO | WO 2012/019630 | 2/2012 |

(Continued)

OTHER PUBLICATIONS

Qi et al. (Nature, 2010, vol. 468, p. 779-785).*
Auperin et al. (Virology, 1989, vol. 168, p. 421-425).*
Bowen et al., "Genetic Diversity among Lassa Virus Strains", *J. Virol.*, 74(15):6992-7004, 2000.
Branco et al., "Lassa virus-like particles displaying all major immunological determinants as a vaccine candidate for Lassa hemorrhagic fever", *Virol. J.*, 7(1):279, 2010.
Bredenbeek et al., "IIA recombinant 1-10, Yellow Fever 17D vaccine expressing Lassa 17-75 virus glycoproteins", *Virology*, 345(2):299-304, 2006.
International Search Report and Written Opinion issued in corresponding PCT Application No. PCT/EP2017/084562, dated May 16, 2018.

(Continued)

*Primary Examiner* — Agnieszka Boesen
(74) *Attorney, Agent, or Firm* — Parker Highlander PLLC

(57) ABSTRACT

The present invention provides mRNAs usable as vaccines against lassa virus (LASV) infections. Further, the invention relates to (pharmaceutical) compositions and vaccines comprising said mRNAs and their use for treatment or prophylaxis of a lassa virus infection. The present invention further features a kit comprising the mRNAs, (pharmaceutical) compositions or vaccines and a method for treatment or prophylaxis of lassa virus infections using said mRNAs, pharmaceutical) compositions or vaccines.

18 Claims, 2 Drawing Sheets
Specification includes a Sequence Listing.

(56) References Cited

U.S. PATENT DOCUMENTS

| | | |
|---|---|---|
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0016669 A1* | 1/2019 | Benenato ............. A61P 43/00 |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |

FOREIGN PATENT DOCUMENTS

| | | |
|---|---|---|
| WO | WO 2012/116714 | 9/2012 |
| WO | WO 2013/055418 | 4/2013 |
| WO | WO 2016/115116 | 7/2016 |
| WO | WO 2017/021546 | 2/2017 |
| WO | WO 2017/025447 | 2/2017 |
| WO | WO 2017/064146 | 4/2017 |
| WO | WO 2017/137095 | 8/2017 |
| WO | WO 2017/140905 | 8/2017 |
| WO | WO 2017/182634 | 10/2017 |
| WO | WO 2017/186928 | 11/2017 |
| WO | WO 2017/191258 | 11/2017 |
| WO | WO 2017/191274 | 11/2017 |
| WO | WO 2017/203008 | 11/2017 |
| WO | WO 2017/212006 | 12/2017 |
| WO | WO 2017/212007 | 12/2017 |
| WO | WO 2017/212008 | 12/2017 |
| WO | WO 2017/212009 | 12/2017 |
| WO | WO 2018/078053 | 5/2018 |
| WO | WO 2018/096179 | 5/2018 |
| WO | WO 2018/104538 | 6/2018 |
| WO | WO 2018/104540 | 6/2018 |
| WO | WO 2018/115507 | 6/2018 |
| WO | WO 2018/115527 | 6/2018 |

OTHER PUBLICATIONS

Jiang et al., "Yellow fever 17D-vectored vaccines expressing Lassa virus GP1 and GP2 glycoproteins provide protection against fatal disease in guinea pigs", *Vaccine*, 29(6):1248-1257, 2010.

Kramps et al., "Messenger RNA-based vaccines: progress, challenges, applications", *Wiley Interdiscip. Rev. RNA*, 4:737-749, 2013.

Schlake et al., "Developing mRNA-vaccine technologies", *RNA Biol.*, 9(11):1319-1330, 2012.

Schnee et al., "An mRNA Vaccine Encoding Rabies Virus Glycoprotein Induces Protection against Lethal Infection in Mice and Correlates of Protection in Adult and Newborn Pigs", *PLoS Neglect. Trop. Dis.*, 10(6):e0004746, 2016.

* cited by examiner

LASSA VIRUS VACCINE

This application is a national phase application under 35 U.S.C. § 371 of International Application No. PCT/EP2017/084562, filed Dec. 22, 2017, which claims benefit of International Application No. PCT/EP2016/082605, filed Dec. 23, 2016, the entire contents of each of which are hereby incorporated by reference.

Lassa virus (LASV) or Lassa mammarenavirus belongs to the Arenaviridae, a family of enveloped viruses with bi-segmented, ambisense single-stranded RNA genomes. The large (L) genomic segment encodes an RNA-dependent RNA polymerase (RdRp) and a zinc-binding matrix protein (Z) (or small RNIG finger z protein, analogous of matrix protein, has been identified as a major budding factor). The small (S) genomic segment encodes the nucleoprotein (NP), and the glycoprotein precursor (GPC). The LASV GPC is synthesized as a single polypeptide and undergoes processing by signal peptidases and cellular pro-protein convertases yielding the stable signal peptide (SSP), the N-terminal GP1, and the transmembrane GP2.

Genetic diversity among LASV strains is the highest among the Arenaviridae, and causes a great challenge for vaccine development. Recent studies using next-generation sequencing (NGS) for confirmed LASV clustering into four major clades and provided further evidence for high LASV genome diversity: overall strain variation among the 54 strains is as high as 27% and 15% at the nucleotide and amino acid levels, respectively (Lukashevich IS. Viruses. 2012 November; 4(11): 2514-2557). LASV in vivo reassortment has been documented suggesting infection of individual hosts with at least two LASV strains from distinguished clades.

People of all ages and sex are susceptible to the LASV infection. Lassa virus is endemic in rural West Africa. LASV has the highest human impact of any of the hemorrhagic fever viruses (with the exception of Dengue fever) with an estimated 100,000-300,000 infections and 5,000-10,000 deaths annually in western Africa. Based on prospective studies performed in four of the most affected countries, Guinea, Sierra-Leone, Liberia, and Nigeria, it is estimated that 59 to 200 million people are at risk of primary LASV infections with an annual incidence of disease as high as 3 million and as many as 67,000 deaths per year. The current areas at risk cover approximately 80% of Sierra-Leone and Liberia, 50% of Guinea, 40% of Nigeria, 30% of each of Côte d'Ivoire, Togo and Benin, and 10% of Ghana (Lukashevich IS. Viruses. 2012 November; 4(11): 2514-2557).

The fatality rate for hospitalized patients is about 17%, but in certain groups of patients, such as pregnant women in their third trimester, more than 30% may die, and fetal or neonatal loss is about 88% (Fisher-Hoch SP et al. J Virol. 2000 August; 74(15):6777-83).

The early stage of human LASV infection is characterized by unspecific signs and symptoms. After an incubation period of 3-21 days, early symptoms include fever, sore throat, retrosternal pain, and myalgia. In progressed LF patients, elevated liver enzymes and high viral load in plasma (viremia) combined with vascular manifestations are indicators of poor prognosis and a fatal outcome.

The pathogenesis of Lassa Fever is still not clearly understood. After crossing the epithelium barrier at the respiratory and gastrointestinal tracts, LASV infects primarily macrophages and dendritic cells (DCs). Efficient virus replication in these cells results in virus dissemination and systemic infection.

Importantly, adaptive cell-mediated responses seem to play a key role in outcome of LASV infection in humans. Growing body of evidence indicates that very early events during the natural infection, probably, even in previremic stage can affect the balance between effective adaptive immune responses and virus replication and determine the clinical outcome (Lukashevich IS and Pushko P Expert Rev Vaccines. 2016 Sep; 15(9):1135-50). T cell responses seem to be central for immunity to LASV. In humans, strong CD4+ T cell memory responses against LASV NP can be recalled in PBMCs for up to six years after the initial infection, and T cell memory responses to GPC are similarly long-lived. Ub nacaqzes, LASV infection that results in a fatal outcome is associated with a lack of demonstrable T cell activation (Prescott et al. Nat Rev Immunol. 2017 Mar; 17(3):195-207).

LASV establishes persistent, asymptomatic infection, with profuse urinary virus excretion in Mastomys natalens/s, a ubiquitous and highly commensal rodent host. Human infection occurs via contact with rodents, inhalation of contaminated droplets/dust, ingestion of contaminated food, or contact with infected patients. Widespread prevention of such contact is presently impractical, and provision of a vaccine for community and hospital use is an imperative public health need.

Currently, there are no licensed treatments specific for Lassa fever. The broad-spectrum antiviral ribavirin seems to benefit patients with Lassa fever if the drug is administered early in the course of disease. The most beneficial current treatment is aggressive supportive care. Therefor, rapid and reliable diagnosis of Lassa virus infection is essential to reduce morbidity and mortality and to support public health measures, such as patient isolation and contact tracing.

There are no licensed vaccines to prevent Lassa virus infections. (Prescott et al. Nat Rev Immunol. 2017 Mar; 17(3):195-207).

Platforms currently being developed for LASV vaccines can be grouped into non-replication competent vaccine platforms and replication-competent vaccine platforms (cf. Lukashevich IS. Viruses. 2012 November; 4(11): 2514-2557 and Lukashevich IS and Pushko P Expert Rev Vaccines. 2016 September; 15(9):1135-50).

A favorable safety profile is the most attractive feature of non-replication competent vaccine platforms such as inactivated ("killed") vaccines or virus-like particles. However, these approaches in general have low immunogenicity and efficacy. To achieve desirable levels of protection these vaccines therefore require multiple prime-boost injections.

Another potential approach includes epitope-based vaccines comprising HLA-binding LASV peptides. However, there are serious safety concerns regarding peptide-based vaccination of individuals recently infected with the virus or in immune individuals previously exposed (perhaps unknowingly/asymptomatically) to the pathogen due to the potential reactivation of CD8+ memory cell progeny leading to potentially fatal immune reactions. Also, since in West Africa the variability of the human HLA genes is very high, a large number of peptides would potentially have to be included in the vaccine, raising a concern regarding the feasibility of this approach.

Virus-based vaccine platforms currently being developed for LASV include alphavirus vector-based vaccines, "live-attenuated" LASV and recombinant vaccinia virus, recombinant Vesicular Stomatitis Virus (VSV), reassortant vaccine platform, MOP/LAS (clone ML29) or recombinant Yellow Fever 17D (YF17D) expressing LASV antigens. However, the development of virus-based vaccine platforms is challenging: while on the one hand, recombinant replication-defective viruses may exhibit a low immunogenicity and thus offer an insufficient protection, on the other hand, viruses exhibiting an immunosuppressive phenotype such as vaccinia virus, or other viruses harboring the potential of reversion to virulence raise safety concerns and are particularly unfeasible for countries with a high prevalence of HIV-1 (cf. Lukashevich IS. Viruses. 2012 November; 4(11): 2514-2557 and Lukashevich IS and Pushko P Expert Rev Vaccines. 2016 September; 15(9):1135-50).

WHO placed Lassa Fever on list of top emerging diseases to accelerate R&D on dangerous pathogens which are most prone to cause epidemics. There is currently no licensed LASV vaccine and vaccine development is hampered by high cost of biocontainment requirement, the absence of appropriate small animal models and genetic diversity of LASV species. LASV vaccine platforms currently under development have been falling short of expectations in terms of safety and efficacy.

There is an urgent need in the art for the provision of a safe and effective LASV vaccine. It is the object of the present invention to comply with this need.

Further needs regarding LASV vaccine properties, characteristics or performances comprise e.g.

Induction of a strong humoral immune response
Induction of B-cell memory
Fast onset of immune protection
Longevity of the induced immune responses
Induction of broad cellular T-cell responses
Induction of a (local and transient) pro-inflammatory environment
No induction of systemic cytokine or chemokine response
Well tolerability, no side-effects, non toxic
Advantageous stability characteristics
Formulation(s) compatible with many different antigens: larger antigen cocktails feasible based on the same (production) technology
No vector immunity, i.e. technology can be used to vaccinate the same subject multiple times against multiple (different) antigens
Speed, adaptability, simplicity and scalability of production Although the present invention is described in detail below, it is to be understood that this invention is not limited to the particular methodologies, protocols and reagents described herein as these may vary. It is also to be understood that the terminology used herein is not intended to limit the scope of the present invention which will be limited only by the appended claims. Unless defined otherwise, all technical and scientific terms used herein have the same meanings as commonly understood by one of ordinary skill in the art.

In the following, the elements of the present invention will be described. These elements are listed with specific embodiments, however, it should be understood that they may be combined in any manner and in any number to create additional embodiments. The variously described examples and preferred embodiments should not be construed to limit the present invention to only the explicitly described embodiments. This description should be understood to support and encompass embodiments which combine the explicitly described embodiments with any number of the disclosed and/or preferred elements. Furthermore, any permutations and combinations of all described elements in this application should be considered disclosed by the description of the present application unless the context indicates otherwise.

Throughout this specification and the claims which follow, unless the context requires otherwise, the term "comprise", and variations such as "comprises" and "comprising", will be understood to imply the inclusion of a stated member, integer or step but not the exclusion of any other non-stated member, integer or step. The term "consist of" is a particular embodiment of the term "comprise", wherein any other non-stated member, integer or step is excluded. In the context of the present invention, the term "comprise" encompasses the term "consist of". The term "comprising" thus encompasses "including" as well as "consisting" e.g., a composition "comprising" X may consist exclusively of X or may include something additional e.g., X+Y.

The terms "a" and "an" and "the" and similar reference used in the context of describing the invention (especially in the context of the claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. No language in the specification should be construed as indicating any non-claimed element essential to the practice of the invention.

The word "substantially" does not exclude "completely" e.g., a composition which is "substantially free" from Y may be completely free from Y. Where necessary, the word "substantially" may be omitted from the definition of the invention.

The term "about" in relation to a numerical value x means x±10%.

In the present invention, if not otherwise indicated, different features of alternatives and embodiments may be combined with each other.

For the sake of clarity and readability the following definitions are provided. Any technical feature mentioned for these definitions may be read on each and every embodiment of the invention. Additional definitions and explanations may be specifically provided in the context of these embodiments.

Definitions

Adaptive immune response: The adaptive immune response is typically understood to be an antigen-specific response of the immune system. Antigen specificity allows for the generation of responses that are tailored, for example, to specific pathogens or pathogen-infected cells. The ability to mount these tailored responses is usually maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. The three cell types that may serve as antigen-presenting cells are dendritic cells, macrophages, and B cells. Each of these cells has a distinct function in eliciting immune responses. Dendritic cells may take up antigens by phagocytosis and macropinocytosis and may become stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. MHC-molecules are, typically, responsible for presentation of an antigen to T-cells. Therein, presenting the antigen on MHC molecules leads to activation of T cells, which induces their proliferation and differentiation into armed effector T cells. The most important function of effector T cells is the killing of infected cells by CD8+ cytotoxic T cells and the activation of macrophages by Th1 cells, which together make up cell-mediated immunity, and the activation of B cells by both Th2 and Th1 cells to produce different classes of antibody, thus driving the humoral immune response. T cells recognize an antigen by their T cell receptors which do not recognize and bind the antigen directly, but instead recognize short peptide fragments e.g. of pathogen-derived protein antigens, e.g. so-called epitopes, which are bound to MHC molecules on the surfaces of other cells.

Adaptive immune system: The adaptive immune system is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered. The system is highly adaptable because of somatic hypermutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to long-lived specific immunity.

Artificial nucleic acid molecule: An artificial nucleic acid molecule may typically be understood to be a nucleic acid molecule, e.g. a DNA or an RNA, that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides, which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Cellular immunity/cellular immune response: Cellular immunity relates typically to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. Such cells may be virus-infected or infected with intracellular bacteria, or cancer cells displaying tumor antigens. Further characteristics may be activation of macrophages and natural killer cells, enabling them to destroy pathogens and stimulation of cells to secrete a variety of cytokines that influence the function of other cells involved in adaptive immune responses and innate immune responses.

DNA: DNA is the usual abbreviation for deoxy-ribonucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by A/T-base-pairing and G/C-base-pairing.

Fragment of a sequence: A fragment of a sequence may typically be a shorter portion of a full-length sequence of e.g. a nucleic acid molecule or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) molecule from which the fragment is derived.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an RNA as defined herein, directly to the patient—by whatever administration route—or in vitro to isolated cells/tissues of the patient, which results in transfection of the patient's cells either in vivo/ex vivo or in vitro, b) transcription and/or translation of the introduced nucleic acid molecule; and optionally c) re-administration of isolated, transfected cells to the patient, if the nucleic acid has not been administered directly to the patient.

Genetic vaccination: Genetic vaccination may typically be understood to be vaccination by administration of a nucleic acid molecule encoding an antigen or an immunogen or fragments thereof. The nucleic acid molecule may be administered to a subject's body or to isolated cells of a subject. Upon transfection of certain cells of the body or upon transfection of the isolated cells, the antigen or immunogen may be expressed by those cells and subsequently presented to the immune system, eliciting an adaptive, i.e. antigen-specific immune response. Accordingly, genetic vaccination typically comprises at least one of the steps of a) administration of a nucleic acid, preferably an artificial nucleic acid molecule as defined herein, to a subject, preferably a patient, or to isolated cells of a subject, preferably a patient, which usually results in transfection of the subject's cells either in vivo or in vitra, b) transcription and/or translation of the introduced nucleic acid molecule; and optionally c) re-administration of isolated, transfected cells to the subject, preferably the patient, if the nucleic acid has not been administered directly to the patient.

Heterologous sequence: Two sequences are typically understood to be "heterologous" if they are not derivable from the same gene. I.e., although heterologous sequences may be derivable from the same organism, they naturally (in nature) do not occur in the same nucleic acid molecule, such as in the same mRNA.

Humoral immunity/humoral immune response: Humoral immunity refers typically to antibody production and optionally to accessory processes accompanying antibody production. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Immunogen: In the context of the present invention, an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid molecule, preferably an artificial nucleic acid molecule as defined herein. Typically, an immunogen elicits at least an adaptive immune response.

Immunostimulatory composition: In the context of the invention, an immunostimulatory composition may be typically understood to be a composition containing at least one component which is able to induce an immune response or from which a component, which is able to induce an immune response, is derivable. Such immune response may be preferably an innate immune response or a combination of an adaptive and an innate immune response. Preferably, an immunostimulatory composition in the context of the invention contains at least one artificial nucleic acid molecule, more preferably an RNA, for example an mRNA molecule.

The immunostimulatory component, such as the mRNA may be complexed with a suitable carrier. Thus, the immunostimulatory composition may comprise an mRNA/carrier-complex. Furthermore, the immunostimulatory composition may comprise an adjuvant and/or a suitable vehicle for the immunostimulatory component, such as the mRNA.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Immunostimulatory RNA: An immunostimulatory RNA (isRNA) in the context of the invention may typically be an RNA that is able to induce an innate immune response. It usually does not have an open reading frame and thus does not provide a peptide-antigen or immunogen but elicits an immune response e.g. by binding to a specific kind of Toll-like-receptor (TLR) or other suitable receptors. However, of course also mRNAs having an open reading frame and coding for a peptide/protein may induce an innate immune response and, thus, may be immunostimulatory RNAs.

Innate immune system: The innate immune system, also known as non-specific (or unspecific) immune system, typically comprises the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g., activated by ligands of Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. The pharmaceutical composition according to the present invention may comprise one or more such substances. Typically, a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system; and/or acting as a physical and chemical barrier to infectious agents.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Nucleic acid molecule: A nucleic acid molecule is a molecule comprising, preferably consisting of nucleic acid components. The term nucleic acid molecule preferably refers to DNA or RNA molecules. It is preferably used synonymous with the term "polynucleotide". Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Open reading frame: An open reading frame (ORF) in the context of the invention may typically be a sequence of several nucleotide triplets, which may be translated into a peptide or protein. An open reading frame preferably contains a start codon, i.e. a combination of three subsequent nucleotides coding usually for the amino acid methionine (ATG), at its 5'-end and a subsequent region, which usually exhibits a length which is a multiple of 3 nucleotides. An ORF is preferably terminated by a stop-codon (e.g., TAA, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The open reading frame may be isolated or it may be incorporated in a longer nucleic acid sequence, for example in a vector or an mRNA. An open reading frame may also be termed "(protein) coding sequence" or, preferably, "coding sequence".

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and 600 monomeric units.

Protein: A protein typically comprises one or more peptides or polypeptides. A protein is typically folded into 3-dimensional form, which may be required for the protein to exert its biological function.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, an open reading frame, a 3'-UTR and a poly(A) sequence. Aside from messenger RNA, several non-coding types of RNA exist which may be involved in regulation of transcription and/or translation.

Sequence of a nucleic acid molecule: The sequence of a nucleic acid molecule is typically understood to be the particular and individual order, i.e. the succession of its nucleotides. The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent to which two sequences are identical, i.e. it typically describes the percentage of nucleotides that correspond in their sequence position with identical nucleotides of a reference-sequence. For determination of the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. In other words, in the context of the present invention, identity of sequences preferably relates to the percentage of nucleotides of a sequence which have the same position in two or more sequences having the same length. Gaps are usually regarded as non-identical positions, irrespective of their actual position in an alignment.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding sequence and the 3'-UTR of an mRNA. An expression vector may be used for production of expression products such as RNA, e.g.

mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid, which is suitable for storing, transporting, and/or administering a pharmaceutically active compound.

SUMMARY OF THE INVENTION

The present invention is based on the inventors' surprising finding that an mRNA encoding at least one antigenic peptide or protein derived from a lassa virus (LASV) efficiently induces antigen-specific immune responses against lassa virus. Furthermore, the inventors surprisingly found that mRNA-based vaccines comprising mRNAs encoding different antigens of a lassa virus (particularly nucleoprotein (NP) and/or glycoprotein precursor (GPC) and/or zinc-binding matrix protein (Z)) can be extremely effective in inducing an antigen-specific immune response against lassa virus, particularly in eliciting effective and long-lasting T cell responses. The inventive mRNA is able to efficiently induce antigen-specific immune responses at a very low dosage and dosing regimen. Furthermore, mRNAs encoding different antigens (optionally of different lassa viruses) can be effectively combined in one mRNA-based vaccine. Additionally, the mRNAs according to the invention enable rapid and rational vaccine design with flexibility, speed and scalability of production probably exceeding those of current virus-based technologies.

Antigenic Peptides or Proteins

In a first aspect, the present invention relates to an mRNA comprising a coding region (or "coding sequence"), encoding at least one antigenic peptide or protein derived from a lassa virus, or a variant or fragment of said antigenic peptide or protein.

As used herein, the term "mRNA" refers to "messenger RNAs", i.e. typically single-strand ribonucleic acid molecules transcribed from DNA that carry genetic information required for protein synthesis from DNA to the ribosomes, that are are inter alia characterized by the specific succession of their nucleotides (i.e. their (m)RNA sequence). The term "mRNA" may thus be used to refer to mRNA molecules or mRNA sequences as will be readily understood by the skilled person in the respective context.

The term "antigenic peptide or protein" refers to (poly-) peptides capable of eliciting an (adaptive) immune response. Such "antigenic peptides or proteins" preferably comprise or provide at least one functional epitope. The term "epitope" or "antigenic determinant" typically refers to the part of an antigen which is recognized by adaptive immune system. An "antigen" is a substance, which is capable of being recognized (typically via its epitope(s)) by the immune system, preferably by the adaptive immune system, and which is capable of eliciting an antigen-specific immune response, e.g. by formation of antibodies and/or antigen-specific T cells as part of an adaptive immune response. In the context of the present invention, "antigens" are preferably peptides or proteins ("antigenic peptides or proteins"). Typically, an antigen comprise or consist a peptide or protein, which may be presented to (antigen-specific) T-cells on MHC surface molecules by the MHC complex. In the sense of the present invention an antigenic peptide or protein is typically the product of translation of a provided nucleic acid molecule, preferably an mRNA as defined herein. As used herein, the term "epitope" in particular refers to a part or fragment of an antigen presented on a MHC surface molecule. Such a fragment comprising or consisting of a (functional) epitope may typically comprise from about 5 to about 20 amino acids. Epitopes can be distinguished in T cell epitopes and B cell epitopes. T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC surface molecule, i.e. the fragments are typically not recognized in their native form. B cell epitopes are typically fragments located on the outer surface of (native) protein or peptide antigens as defined herein, preferably having 5 to 15 amino acids, more preferably having 5 to 12 amino acids, even more preferably having 6 to 9 amino acids, which may be recognized by antibodies, i.e. in their native form. The term "epitope" includes "conformational" (or "discontinuous") epitopes, which are composed of discontinuous sequences of the amino acids of the antigen but are brought together in the three-dimensional structure, and "linear" epitopes, which are formed by a continuous sequence of amino acids from the antigen.

The expression "mRNA encoding a . . . protein derived from a lassa virus" may preferably refer to and may be used interchangeably with the expression "mRNA encoding a . . . protein corresponding to a . . . protein of lassa virus" or simply "mRNA encoding a lassa virus . . . protein".

The inventive mRNA thus preferably comprises a coding region encoding a full-length antigenic peptide or protein derived from a lassa virus, or a variant or fragment thereof, wherein said antigenic peptide or protein preferably comprises or provides at least one (functional) epitope, i.e. said antigenic peptide or protein preferably either comprise a native epitope (preferably recognized by B cells) or is processed to yield a MHC-bound epitope (preferably recognized by T cells), said epitope preferably being capable of inducing the desired adaptive immune response in a subject.

In preferred embodiments, the coding region of the inventive mRNA encodes at least one antigenic peptide or protein derived from glycoprotein precursor (GPC) of a lassa virus, or a variant or fragment thereof, and/or at least one antigenic peptide or protein derived from nucleoprotein (NP) of a lassa virus, and/or at least one antigenic peptide or protein derived from zinc-binding matrix protein (Z) of a lassa virus, or a variant or fragment thereof.

Thus, the inventive mRNA may encode (i) at least one antigenic peptide or protein derived from glycoprotein precursor (GPC) of a lassa virus (e.g. full-length glycoprotein precursor (GPC) of a lassa virus, or a variant or fragment thereof) (ii) at least one antigenic peptide or protein derived from nucleoprotein (NP) of a lassa virus, or a variant or fragment thereof (e.g. full-length nucleoprotein (NP) of a lassa virus, or a variant or fragment thereof), (iiI) at least one antigenic peptide or protein derived from zinc-binding matrix protein (Z) of a lassa virus, or a variant or fragment thereof (e.g. full-length zinc-binding matrix protein (Z) of a lassa virus, or a variant or fragment thereof), (iv) a combination thereof, wherein a "combination" in this context includes combinations of separate antigenic proteins or peptides (preferably encoded by different ORFs in the coding region) or fusion proteins comprising any combination of the aforementioned antigenic proteins or peptides joined together optionally via a suitable peptide linker.

In preferred embodiments, the mRNA according to the invention is provided as (or usable as) a vaccine.

In a preferred embodiment, the inventive mRNA comprises a coding region, encoding at least one antigenic peptide or protein derived from nucleoprotein (NP) of a lassa virus or a variant or fragment of said NP and/or at least one antigenic peptide or protein derived from glycoprotein precursor (GPC) of a lassa virus or a variant or fragment of said GPC and/or at least one antigenic peptide or protein derived from zinc-binding matrix protein (Z) of a lassa virus or a variant or fragment of said Z. Accordingly, the amino acid sequence of the at least one antigenic peptide or protein encoded by the inventive mRNA may be selected from any peptide or protein derived from nucleoprotein (NP) of a lassa virus or a variant or fragment of said NP or a glycoprotein precursor (GPC) of a lassa virus or a variant or fragment of said GPC or zinc-binding matrix protein (Z) of a lassa virus or a variant or fragment of said Z or from any synthetically engineered lassa virus peptide or protein.

Clades or Lineages

The antigenic peptide(s) or protein(s) encoded by the coding region of the inventive mRNA may be derived from the same lassa virus or from different lassa viruses. In specific embodiments the lassa virus peptide(s) or protein(s) encoded by the at least one mRNA(s) are derived from a lassa virus of clade I, II, III or IV or from a lassa virus of lineage I, II, III or IV.

In a further specific embodiments the lassa virus peptide(s) or protein(s) encoded by the at least one mRNA(s) are derived from a lassa virus of clade I, II, III and/or IV or from a lassa virus of lineage I, II, III and/or IV.

In a further embodiments the lassa virus peptide(s) or protein(s) encoded by the at least one mRNA(s) are derived from a lassa virus of clade I, II, III and IV or from a lassa virus of lineage I, II, III and IV.

Per definition, a lineage is a single line of descent or linear chain within the phylogenetic tree, while a clade is a (usually branched) monophyletic group, containing a single ancestor and all its descendants. FIG. 2 shows a phylogenetic tree that shows relationships among Lassa virus strains (Bowen, J. Virol. 2000; 6992-7004). The four Lassa virus lineages are labeled from I through IV. Representative strains from each of the four lineages are shown in outline (Lineage I: LP strain, Lineage II: strain 803213, Lineage III: GA391 and Lineage IV: Josiah).

The overall topology of the most parsimonious tree suggests that the LP strain (lineage I) occupies the most basal position within the Lassa clade, followed by lineage II (southern central Nigeria). Lineages III (northern central Nigeria) and IV (Guinea, Liberia, and Sierra Leone) exhibit a sister relationship. Lineage IV is the largest group of Lassa virus strains and contains all strains from Guinea, Liberia, and Sierra Leone. Sequence differences within and between lineages can be determined by comparing the sequences of different strains, generally in the region of the NP gene, e.g. by means of the specified primers for RT-PCR described in Bowen J. Virol. 2000; 6992-7004).

The overall genetic diversity within Lassa virus strains is great, approaching a maximum of 26.8% nucleotide and 14.8% deduced amino acid divergence. Within lineages, the diversity is generally less than 20% at the nucleotide level and 11% at the amino acid level except for lineage III when the outlier strain 9608911 is included. Within lineage IV, less variation is observed within strains from Sierra Leone than in Guinean and Liberian strains. Variation between lineages ranges from 19% to almost 27% at the nucleotide level and 6.7% to almost 15% at the amino acid level.

A further method to determine the sequence variability or the genetic diversity on the basis of e.g. the GPC gene is described in Leski et al (Emerg Infect Dis. 2015 April; 21(4): 609-618).

In a specific embodiments the lassa virus peptide(s) or protein(s) encoded by the at least one mRNA(s) are derived from at least two different lassa virus strains of clade I, II, III and/or IV or from a lassa virus of lineage I, II, III and/or IV, wherein the the at least two lassa virus proteins exhibit considerable sequence dissimilarities. In a preferred embodiment, the dissimilarities are greater than 11% amino acid sequence divergence in the region of the NP gene. In a second embodiment, the sequence divergence of the mRNA encoding the lassa virus protein is greater than 22% nucleotide sequence divergence.

Full-Length Antigenic Proteins and Variants Thereof

In preferred embodiments, the at least one coding region of the inventive mRNA encodes at least one full-length protein of nucleoprotein (NP) (or a variant thereof) of a lassa virus and/or at least one full-length glycoprotein precursor (GPC) (or a variant thereof) of a lassa virus and/or at least one full-length zinc-binding matrix protein (Z) (or a variant thereof) of a lassa virus.

The term "full-length protein" or as used herein typically refers to a protein that substantially comprises the entire amino acid sequence of the naturally occurring (wild type) protein. Accordingly, in a preferred embodiment, the at least one coding sequence of the inventive mRNA encodes a full-length antigenic protein derived from a lassa virus or a variant of said protein, wherein said protein is preferably selected from the proteins disclosed in Tables 1-3.

TABLE 1

| | | | Lassa virus Glycoprotein (GPC) | | | |
|---|---|---|---|---|---|---|
| Row | column 1 NCBI Accession No. | column 2 A | column 3 B | column 4 C | column 5 D | column 6 E | column 7 F |
| 1 | AAF86703 | 1 | 376 | 751, 1126, 1501, 1876, 2251, 2626, 3001 | 4828 | 5356 | 5884 |
| 2 | AAG41802 | 2 | 377 | 752, 1127, 1502, 1877, 2252, 2627, 3002 | 4829 | 5357 | 5885 |
| 3 | AAL13212 | 3 | 378 | 753, 1128, 1503, 1878, 2253, 2628, 3003 | 4830 | 5358 | 5886 |
| 4 | AAO59512 | 4 | 379 | 754, 1129, 1504, 1879, 2254, 2629, 3004 | 4831 | 5359 | 5887 |
| 5 | AAT49000 | 5 | 380 | 755, 1130, 1505, 1880, 2255, 2630, 3005 | 4832 | 5360 | 5888 |
| 6 | AAT49004 | 6 | 381 | 756, 1131, 1506, 1881, 2256, 2631, 3006 | 4833 | 5361 | 5889 |
| 7 | AAT49008 | 7 | 382 | 757, 1132, 1507, 1882, 2257, 2632, 3007 | 4834 | 5362 | 5890 |
| 8 | AAT49010 | 8 | 383 | 758, 1133, 1508, 1883, 2258, 2633, 3008 | 4835 | 5363 | 5891 |
| 9 | AAT49014 | 9 | 384 | 759, 1134, 1509, 1884, 2259, 2634, 3009 | 4836 | 5364 | 5892 |
| 10 | AAV54104 | 10 | 385 | 760, 1135, 1510, 1885, 2260, 2635, 3010 | 4837 | 5365 | 5893 |
| 11 | ADI39451 | 11 | 386 | 761, 1136, 1511, 1886, 2261, 2636, 3011 | 4838 | 5366 | 5894 |
| 12 | ADU56610 | 12 | 387 | 762, 1137, 1512, 1887, 2262, 2637, 3012 | 4839 | 5367 | 5895 |
| 13 | ADU56618 | 13 | 388 | 763, 1138, 1513, 1888, 2263, 2638, 3013 | 4840 | 5368 | 5896 |
| 14 | ADU56622 | 14 | 389 | 764, 1139, 1514, 1889, 2264, 2639, 3014 | 4841 | 5369 | 5897 |
| 15 | ADU56626 | 15 | 390 | 765, 1140, 1515, 1890, 2265, 2640, 3015 | 4842 | 5370 | 5898 |
| 16 | ADU56630 | 16 | 391 | 766, 1141, 1516, 1891, 2266, 2641, 3016 | 4843 | 5371 | 5899 |
| 17 | AFY05588 | 17 | 392 | 767, 1142, 1517, 1892, 2267, 2642, 3017 | 4844 | 5372 | 5900 |
| 18 | AFY05590 | 18 | 393 | 768, 1143, 1518, 1893, 2268, 2643, 3018 | 4845 | 5373 | 5901 |
| 19 | AHC95553 | 19 | 394 | 769, 1144, 1519, 1894, 2269, 2644, 3019 | 4846 | 5374 | 5902 |
| 20 | AHC95555 | 20 | 395 | 770, 1145, 1520, 1895, 2270, 2645, 3020 | 4847 | 5375 | 5903 |
| 21 | AHC95557 | 21 | 396 | 771, 1146, 1521, 1896, 2271, 2646, 3021 | 4848 | 5376 | 5904 |
| 22 | AHC95559 | 22 | 397 | 772, 1147, 1522, 1897, 2272, 2647, 3022 | 4849 | 5377 | 5905 |
| 23 | AIT17126 | 23 | 398 | 773, 1148, 1523, 1898, 2273, 2648, 3023 | 4850 | 5378 | 5906 |
| 24 | AIT17130 | 24 | 399 | 774, 1149, 1524, 1899, 2274, 2649, 3024 | 4851 | 5379 | 5907 |
| 25 | AIT17134 | 25 | 400 | 775, 1150, 1525, 1900, 2275, 2650, 3025 | 4852 | 5380 | 5908 |
| 26 | AIT17138 | 26 | 401 | 776, 1151, 1526, 1901, 2276, 2651, 3026 | 4853 | 5381 | 5909 |
| 27 | AIT17142 | 27 | 402 | 777, 1152, 1527, 1902, 2277, 2652, 3027 | 4854 | 5382 | 5910 |
| 28 | AIT17146 | 28 | 403 | 778, 1153, 1528, 1903, 2278, 2653, 3028 | 4855 | 5383 | 5911 |
| 29 | AIT17154 | 29 | 404 | 779, 1154, 1529, 1904, 2279, 2654, 3029 | 4856 | 5384 | 5912 |
| 30 | AIT17158 | 30 | 405 | 780, 1155, 1530, 1905, 2280, 2655, 3030 | 4857 | 5385 | 5913 |
| 31 | AIT17164 | 31 | 406 | 781, 1156, 1531, 1906, 2281, 2656, 3031 | 4858 | 5386 | 5914 |
| 32 | AIT17168 | 32 | 407 | 782, 1157, 1532, 1907, 2282, 2657, 3032 | 4859 | 5387 | 5915 |
| 33 | AIT17172 | 33 | 408 | 783, 1158, 1533, 1908, 2283, 2658, 3033 | 4860 | 5388 | 5916 |
| 34 | AIT17176 | 34 | 409 | 784, 1159, 1534, 1909, 2284, 2659, 3034 | 4861 | 5389 | 5917 |
| 35 | AIT17180 | 35 | 410 | 785, 1160, 1535, 1910, 2285, 2660, 3035 | 4862 | 5390 | 5918 |
| 36 | AIT17184 | 36 | 411 | 786, 1161, 1536, 1911, 2286, 2661, 3036 | 4863 | 5391 | 5919 |

TABLE 1-continued

Lassa virus Glycoprotein (GPC)

| Row | column 1 NCBI Accession No. | column 2 A | column 3 B | column 4 C | column 5 D | column 6 E | column 7 F |
|---|---|---|---|---|---|---|---|
| 37 | AIT17188 | 37 | 412 | 787, 1162, 1537, 1912, 2287, 2662, 3037 | 4864 | 5392 | 5920 |
| 38 | AIT17192 | 38 | 413 | 788, 1163, 1538, 1913, 2288, 2663, 3038 | 4865 | 5393 | 5921 |
| 39 | AIT17196 | 39 | 414 | 789, 1164, 1539, 1914, 2289, 2664, 3039 | 4866 | 5394 | 5922 |
| 40 | AIT17204 | 40 | 415 | 790, 1165, 1540, 1915, 2290, 2665, 3040 | 4867 | 5395 | 5923 |
| 41 | AIT17208 | 41 | 416 | 791, 1166, 1541, 1916, 2291, 2666, 3041 | 4868 | 5396 | 5924 |
| 42 | AIT17210 | 42 | 417 | 792, 1167, 1542, 1917, 2292, 2667, 3042 | 4869 | 5397 | 5925 |
| 43 | AIT17212 | 43 | 418 | 793, 1168, 1543, 1918, 2293, 2668, 3043 | 4870 | 5398 | 5926 |
| 44 | AIT17216 | 44 | 419 | 794, 1169, 1544, 1919, 2294, 2669, 3044 | 4871 | 5399 | 5927 |
| 45 | AIT17224 | 45 | 420 | 795, 1170, 1545, 1920, 2295, 2670, 3045 | 4872 | 5400 | 5928 |
| 46 | AIT17228 | 46 | 421 | 796, 1171, 1546, 1921, 2296, 2671, 3046 | 4873 | 5401 | 5929 |
| 47 | AIT17232 | 47 | 422 | 797, 1172, 1547, 1922, 2297, 2672, 3047 | 4874 | 5402 | 5930 |
| 48 | AIT17236 | 48 | 423 | 798, 1173, 1548, 1923, 2298, 2673, 3048 | 4875 | 5403 | 5931 |
| 49 | AIT17240 | 49 | 424 | 799, 1174, 1549, 1924, 2299, 2674, 3049 | 4876 | 5404 | 5932 |
| 50 | AIT17244 | 50 | 425 | 800, 1175, 1550, 1925, 2300, 2675, 3050 | 4877 | 5405 | 5933 |
| 51 | AIT17246 | 51 | 426 | 801, 1176, 1551, 1926, 2301, 2676, 3051 | 4878 | 5406 | 5934 |
| 52 | AIT17250 | 52 | 427 | 802, 1177, 1552, 1927, 2302, 2677, 3052 | 4879 | 5407 | 5935 |
| 53 | AIT17254 | 53 | 428 | 803, 1178, 1553, 1928, 2303, 2678, 3053 | 4880 | 5408 | 5936 |
| 54 | AIT17258 | 54 | 429 | 804, 1179, 1554, 1929, 2304, 2679, 3054 | 4881 | 5409 | 5937 |
| 55 | AIT17262 | 55 | 430 | 805, 1180, 1555, 1930, 2305, 2680, 3055 | 4882 | 5410 | 5938 |
| 56 | AIT17266 | 56 | 431 | 806, 1181, 1556, 1931, 2306, 2681, 3056 | 4883 | 5411 | 5939 |
| 57 | AIT17270 | 57 | 432 | 807, 1182, 1557, 1932, 2307, 2682, 3057 | 4884 | 5412 | 5940 |
| 58 | AIT17274 | 58 | 433 | 808, 1183, 1558, 1933, 2308, 2683, 3058 | 4885 | 5413 | 5941 |
| 59 | AIT17276 | 59 | 434 | 809, 1184, 1559, 1934, 2309, 2684, 3059 | 4886 | 5414 | 5942 |
| 60 | AIT17280 | 60 | 435 | 810, 1185, 1560, 1935, 2310, 2685, 3060 | 4887 | 5415 | 5943 |
| 61 | AIT17288 | 61 | 436 | 811, 1186, 1561, 1936, 2311, 2686, 3061 | 4888 | 5416 | 5944 |
| 62 | AIT17292 | 62 | 437 | 812, 1187, 1562, 1937, 2312, 2687, 3062 | 4889 | 5417 | 5945 |
| 63 | AIT17294 | 63 | 438 | 813, 1188, 1563, 1938, 2313, 2688, 3063 | 4890 | 5418 | 5946 |
| 64 | AIT17298 | 64 | 439 | 814, 1189, 1564, 1939, 2314, 2689, 3064 | 4891 | 5419 | 5947 |
| 65 | AIT17302 | 65 | 440 | 815, 1190, 1565, 1940, 2315, 2690, 3065 | 4892 | 5420 | 5948 |
| 66 | AIT17310 | 66 | 441 | 816, 1191, 1566, 1941, 2316, 2691, 3066 | 4893 | 5421 | 5949 |
| 67 | AIT17314 | 67 | 442 | 817, 1192, 1567, 1942, 2317, 2692, 3067 | 4894 | 5422 | 5950 |
| 68 | AIT17318 | 68 | 443 | 818, 1193, 1568, 1943, 2318, 2693, 3068 | 4895 | 5423 | 5951 |
| 69 | AIT17322 | 69 | 444 | 819, 1194, 1569, 1944, 2319, 2694, 3069 | 4896 | 5424 | 5952 |
| 70 | AIT17328 | 70 | 445 | 820, 1195, 1570, 1945, 2320, 2695, 3070 | 4897 | 5425 | 5953 |
| 71 | AIT17332 | 71 | 446 | 821, 1196, 1571, 1946, 2321, 2696, 3071 | 4898 | 5426 | 5954 |
| 72 | AIT17340 | 72 | 447 | 822, 1197, 1572, 1947, 2322, 2697, 3072 | 4899 | 5427 | 5955 |

TABLE 1-continued

Lassa virus Glycoprotein (GPC)

| Row | column 1 NCBI Accession No. | column 2 A | column 3 B | column 4 C | column 5 D | column 6 E | column 7 F |
|---|---|---|---|---|---|---|---|
| 73 | AIT17344 | 73 | 448 | 823, 1198, 1573, 1948, 2323, 2698, 3073 | 4900 | 5428 | 5956 |
| 74 | AIT17348 | 74 | 449 | 824, 1199, 1574, 1949, 2324, 2699, 3074 | 4901 | 5429 | 5957 |
| 75 | AIT17350 | 75 | 450 | 825, 1200, 1575, 1950, 2325, 2700, 3075 | 4902 | 5430 | 5958 |
| 76 | AIT17354 | 76 | 451 | 826, 1201, 1576, 1951, 2326, 2701, 3076 | 4903 | 5431 | 5959 |
| 77 | AIT17360 | 77 | 452 | 827, 1202, 1577, 1952, 2327, 2702, 3077 | 4904 | 5432 | 5960 |
| 78 | AIT17364 | 78 | 453 | 828, 1203, 1578, 1953, 2328, 2703, 3078 | 4905 | 5433 | 5961 |
| 79 | AIT17368 | 79 | 454 | 829, 1204, 1579, 1954, 2329, 2704, 3079 | 4906 | 5434 | 5962 |
| 80 | AIT17370 | 80 | 455 | 830, 1205, 1580, 1955, 2330, 2705, 3080 | 4907 | 5435 | 5963 |
| 81 | AIT17378 | 81 | 456 | 831, 1206, 1581, 1956, 2331, 2706, 3081 | 4908 | 5436 | 5964 |
| 82 | AIT17388 | 82 | 457 | 832, 1207, 1582, 1957, 2332, 2707, 3082 | 4909 | 5437 | 5965 |
| 83 | AIT17404 | 83 | 458 | 833, 1208, 1583, 1958, 2333, 2708, 3083 | 4910 | 5438 | 5966 |
| 84 | AIT17408 | 84 | 459 | 834, 1209, 1584, 1959, 2334, 2709, 3084 | 4911 | 5439 | 5967 |
| 85 | AIT17412 | 85 | 460 | 835, 1210, 1585, 1960, 2335, 2710, 3085 | 4912 | 5440 | 5968 |
| 86 | AIT17416 | 86 | 461 | 836, 1211, 1586, 1961, 2336, 2711, 3086 | 4913 | 5441 | 5969 |
| 87 | AIT17420 | 87 | 462 | 837, 1212, 1587, 1962, 2337, 2712, 3087 | 4914 | 5442 | 5970 |
| 88 | AIT17424 | 88 | 463 | 838, 1213, 1588, 1963, 2338, 2713, 3088 | 4915 | 5443 | 5971 |
| 89 | AIT17428 | 89 | 464 | 839, 1214, 1589, 1964, 2339, 2714, 3089 | 4916 | 5444 | 5972 |
| 90 | AIT17430 | 90 | 465 | 840, 1215, 1590, 1965, 2340, 2715, 3090 | 4917 | 5445 | 5973 |
| 91 | AIT17438 | 91 | 466 | 841, 1216, 1591, 1966, 2341, 2716, 3091 | 4918 | 5446 | 5974 |
| 92 | AIT17442 | 92 | 467 | 842, 1217, 1592, 1967, 2342, 2717, 3092 | 4919 | 5447 | 5975 |
| 93 | AIT17446 | 93 | 468 | 843, 1218, 1593, 1968, 2343, 2718, 3093 | 4920 | 5448 | 5976 |
| 94 | AIT17450 | 94 | 469 | 844, 1219, 1594, 1969, 2344, 2719, 3094 | 4921 | 5449 | 5977 |
| 95 | AIT17454 | 95 | 470 | 845, 1220, 1595, 1970, 2345, 2720, 3095 | 4922 | 5450 | 5978 |
| 96 | AIT17458 | 96 | 471 | 846, 1221, 1596, 1971, 2346, 2721, 3096 | 4923 | 5451 | 5979 |
| 97 | AIT17462 | 97 | 472 | 847, 1222, 1597, 1972, 2347, 2722, 3097 | 4924 | 5452 | 5980 |
| 98 | AIT17466 | 98 | 473 | 848, 1223, 1598, 1973, 2348, 2723, 3098 | 4925 | 5453 | 5981 |
| 99 | AIT17470 | 99 | 474 | 849, 1224, 1599, 1974, 2349, 2724, 3099 | 4926 | 5454 | 5982 |
| 100 | AIT17474 | 100 | 475 | 850, 1225, 1600, 1975, 2350, 2725, 3100 | 4927 | 5455 | 5983 |
| 101 | AIT17478 | 101 | 476 | 851, 1226, 1601, 1976, 2351, 2726, 3101 | 4928 | 5456 | 5984 |
| 102 | AIT17482 | 102 | 477 | 852, 1227, 1602, 1977, 2352, 2727, 3102 | 4929 | 5457 | 5985 |
| 103 | AIT17486 | 103 | 478 | 853, 1228, 1603, 1978, 2353, 2728, 3103 | 4930 | 5458 | 5986 |
| 104 | AIT17490 | 104 | 479 | 854, 1229, 1604, 1979, 2354, 2729, 3104 | 4931 | 5459 | 5987 |
| 105 | AIT17494 | 105 | 480 | 855, 1230, 1605, 1980, 2355, 2730, 3105 | 4932 | 5460 | 5988 |
| 106 | AIT17498 | 106 | 481 | 856, 1231, 1606, 1981, 2356, 2731, 3106 | 4933 | 5461 | 5989 |
| 107 | AIT17502 | 107 | 482 | 857, 1232, 1607, 1982, 2357, 2732, 3107 | 4934 | 5462 | 5990 |
| 108 | AIT17506 | 108 | 483 | 858, 1233, 1608, 1983, 2358, 2733, 3108 | 4935 | 5463 | 5991 |

TABLE 1-continued

Lassa virus Glycoprotein (GPC)

| Row | column 1 NCBI Accession No. | column 2 A | column 3 B | column 4 C | column 5 D | column 6 E | column 7 F |
|---|---|---|---|---|---|---|---|
| 109 | AIT17510 | 109 | 484 | 859, 1234, 1609, 1984, 2359, 2734, 3109 | 4936 | 5464 | 5992 |
| 110 | AIT17514 | 110 | 485 | 860, 1235, 1610, 1985, 2360, 2735, 3110 | 4937 | 5465 | 5993 |
| 111 | AIT17518 | 111 | 486 | 861, 1236, 1611, 1986, 2361, 2736, 3111 | 4938 | 5466 | 5994 |
| 112 | AIT17524 | 112 | 487 | 862, 1237, 1612, 1987, 2362, 2737, 3112 | 4939 | 5467 | 5995 |
| 113 | AIT17528 | 113 | 488 | 863, 1238, 1613, 1988, 2363, 2738, 3113 | 4940 | 5468 | 5996 |
| 114 | AIT17538 | 114 | 489 | 864, 1239, 1614, 1989, 2364, 2739, 3114 | 4941 | 5469 | 5997 |
| 115 | AIT17540 | 115 | 490 | 865, 1240, 1615, 1990, 2365, 2740, 3115 | 4942 | 5470 | 5998 |
| 116 | AIT17544 | 116 | 491 | 866, 1241, 1616, 1991, 2366, 2741, 3116 | 4943 | 5471 | 5999 |
| 117 | AIT17548 | 117 | 492 | 867, 1242, 1617, 1992, 2367, 2742, 3117 | 4944 | 5472 | 6000 |
| 118 | AIT17552 | 118 | 493 | 868, 1243, 1618, 1993, 2368, 2743, 3118 | 4945 | 5473 | 6001 |
| 119 | AIT17556 | 119 | 494 | 869, 1244, 1619, 1994, 2369, 2744, 3119 | 4946 | 5474 | 6002 |
| 120 | AIT17560 | 120 | 495 | 870, 1245, 1620, 1995, 2370, 2745, 3120 | 4947 | 5475 | 6003 |
| 121 | AIT17564 | 121 | 496 | 871, 1246, 1621, 1996, 2371, 2746, 3121 | 4948 | 5476 | 6004 |
| 122 | AIT17572 | 122 | 497 | 872, 1247, 1622, 1997, 2372, 2747, 3122 | 4949 | 5477 | 6005 |
| 123 | AIT17576 | 123 | 498 | 873, 1248, 1623, 1998, 2373, 2748, 3123 | 4950 | 5478 | 6006 |
| 124 | AIT17580 | 124 | 499 | 874, 1249, 1624, 1999, 2374, 2749, 3124 | 4951 | 5479 | 6007 |
| 125 | AIT17584 | 125 | 500 | 875, 1250, 1625, 2000, 2375, 2750, 3125 | 4952 | 5480 | 6008 |
| 126 | AIT17588 | 126 | 501 | 876, 1251, 1626, 2001, 2376, 2751, 3126 | 4953 | 5481 | 6009 |
| 127 | AIT17592 | 127 | 502 | 877, 1252, 1627, 2002, 2377, 2752, 3127 | 4954 | 5482 | 6010 |
| 128 | AIT17596 | 128 | 503 | 878, 1253, 1628, 2003, 2378, 2753, 3128 | 4955 | 5483 | 6011 |
| 129 | AIT17600 | 129 | 504 | 879, 1254, 1629, 2004, 2379, 2754, 3129 | 4956 | 5484 | 6012 |
| 130 | AIT17604 | 130 | 505 | 880, 1255, 1630, 2005, 2380, 2755, 3130 | 4957 | 5485 | 6013 |
| 131 | AIT17608 | 131 | 506 | 881, 1256, 1631, 2006, 2381, 2756, 3131 | 4958 | 5486 | 6014 |
| 132 | AIT17612 | 132 | 507 | 882, 1257, 1632, 2007, 2382, 2757, 3132 | 4959 | 5487 | 6015 |
| 133 | AIT17616 | 133 | 508 | 883, 1258, 1633, 2008, 2383, 2758, 3133 | 4960 | 5488 | 6016 |
| 134 | AIT17620 | 134 | 509 | 884, 1259, 1634, 2009, 2384, 2759, 3134 | 4961 | 5489 | 6017 |
| 135 | AIT17626 | 135 | 510 | 885, 1260, 1635, 2010, 2385, 2760, 3135 | 4962 | 5490 | 6018 |
| 136 | AIT17630 | 136 | 511 | 886, 1261, 1636, 2011, 2386, 2761, 3136 | 4963 | 5491 | 6019 |
| 137 | AIT17634 | 137 | 512 | 887, 1262, 1637, 2012, 2387, 2762, 3137 | 4964 | 5492 | 6020 |
| 138 | AIT17638 | 138 | 513 | 888, 1263, 1638, 2013, 2388, 2763, 3138 | 4965 | 5493 | 6021 |
| 139 | AIT17642 | 139 | 514 | 889, 1264, 1639, 2014, 2389, 2764, 3139 | 4966 | 5494 | 6022 |
| 140 | AIT17646 | 140 | 515 | 890, 1265, 1640, 2015, 2390, 2765, 3140 | 4967 | 5495 | 6023 |
| 141 | AIT17650 | 141 | 516 | 891, 1266, 1641, 2016, 2391, 2766, 3141 | 4968 | 5496 | 6024 |
| 142 | AIT17658 | 142 | 517 | 892, 1267, 1642, 2017, 2392, 2767, 3142 | 4969 | 5497 | 6025 |
| 143 | AIT17666 | 143 | 518 | 893, 1268, 1643, 2018, 2393, 2768, 3143 | 4970 | 5498 | 6026 |
| 144 | AIT17670 | 144 | 519 | 894, 1269, 1644, 2019, 2394, 2769, 3144 | 4971 | 5499 | 6027 |

TABLE 1-continued

| | | | Lassa virus Glycoprotein (GPC) | | | |
|---|---|---|---|---|---|---|
| Row | column 1 NCBI Accession No. | column 2 A | column 3 B | column 4 C | column 5 D | column 6 E | column 7 F |
| 145 | AIT17674 | 145 | 520 | 895, 1270, 1645, 2020, 2395, 2770, 3145 | 4972 | 5500 | 6028 |
| 146 | AIT17678 | 146 | 521 | 896, 1271, 1646, 2021, 2396, 2771, 3146 | 4973 | 5501 | 6029 |
| 147 | AIT17686 | 147 | 522 | 897, 1272, 1647, 2022, 2397, 2772, 3147 | 4974 | 5502 | 6030 |
| 148 | AIT17690 | 148 | 523 | 898, 1273, 1648, 2023, 2398, 2773, 3148 | 4975 | 5503 | 6031 |
| 149 | AIT17694 | 149 | 524 | 899, 1274, 1649, 2024, 2399, 2774, 3149 | 4976 | 5504 | 6032 |
| 150 | AIT17712 | 150 | 525 | 900, 1275, 1650, 2025, 2400, 2775, 3150 | 4977 | 5505 | 6033 |
| 151 | AIT17718 | 151 | 526 | 901, 1276, 1651, 2026, 2401, 2776, 3151 | 4978 | 5506 | 6034 |
| 152 | AIT17724 | 152 | 527 | 902, 1277, 1652, 2027, 2402, 2777, 3152 | 4979 | 5507 | 6035 |
| 153 | AIT17728 | 153 | 528 | 903, 1278, 1653, 2028, 2403, 2778, 3153 | 4980 | 5508 | 6036 |
| 154 | AIT17732 | 154 | 529 | 904, 1279, 1654, 2029, 2404, 2779, 3154 | 4981 | 5509 | 6037 |
| 155 | AIT17736 | 155 | 530 | 905, 1280, 1655, 2030, 2405, 2780, 3155 | 4982 | 5510 | 6038 |
| 156 | AIT17744 | 156 | 531 | 906, 1281, 1656, 2031, 2406, 2781, 3156 | 4983 | 5511 | 6039 |
| 157 | AIT17752 | 157 | 532 | 907, 1282, 1657, 2032, 2407, 2782, 3157 | 4984 | 5512 | 6040 |
| 158 | AIT17756 | 158 | 533 | 908, 1283, 1658, 2033, 2408, 2783, 3158 | 4985 | 5513 | 6041 |
| 159 | AIT17758 | 159 | 534 | 909, 1284, 1659, 2034, 2409, 2784, 3159 | 4986 | 5514 | 6042 |
| 160 | AIT17762 | 160 | 535 | 910, 1285, 1660, 2035, 2410, 2785, 3160 | 4987 | 5515 | 6043 |
| 161 | AIT17770 | 161 | 536 | 911, 1286, 1661, 2036, 2411, 2786, 3161 | 4988 | 5516 | 6044 |
| 162 | AIT17778 | 162 | 537 | 912, 1287, 1662, 2037, 2412, 2787, 3162 | 4989 | 5517 | 6045 |
| 163 | AIT17782 | 163 | 538 | 913, 1288, 1663, 2038, 2413, 2788, 3163 | 4990 | 5518 | 6046 |
| 164 | AIT17786 | 164 | 539 | 914, 1289, 1664, 2039, 2414, 2789, 3164 | 4991 | 5519 | 6047 |
| 165 | AIT17790 | 165 | 540 | 915, 1290, 1665, 2040, 2415, 2790, 3165 | 4992 | 5520 | 6048 |
| 166 | AIT17798 | 166 | 541 | 916, 1291, 1666, 2041, 2416, 2791, 3166 | 4993 | 5521 | 6049 |
| 167 | AIT17802 | 167 | 542 | 917, 1292, 1667, 2042, 2417, 2792, 3167 | 4994 | 5522 | 6050 |
| 168 | AIT17806 | 168 | 543 | 918, 1293, 1668, 2043, 2418, 2793, 3168 | 4995 | 5523 | 6051 |
| 169 | AIT17810 | 169 | 544 | 919, 1294, 1669, 2044, 2419, 2794, 3169 | 4996 | 5524 | 6052 |
| 170 | AIT17814 | 170 | 545 | 920, 1295, 1670, 2045, 2420, 2795, 3170 | 4997 | 5525 | 6053 |
| 171 | AIT17820 | 171 | 546 | 921, 1296, 1671, 2046, 2421, 2796, 3171 | 4998 | 5526 | 6054 |
| 172 | AIT17824 | 172 | 547 | 922, 1297, 1672, 2047, 2422, 2797, 3172 | 4999 | 5527 | 6055 |
| 173 | AIT17828 | 173 | 548 | 923, 1298, 1673, 2048, 2423, 2798, 3173 | 5000 | 5528 | 6056 |
| 174 | AIT17836 | 174 | 549 | 924, 1299, 1674, 2049, 2424, 2799, 3174 | 5001 | 5529 | 6057 |
| 175 | AIT17840 | 175 | 550 | 925, 1300, 1675, 2050, 2425, 2800, 3175 | 5002 | 5530 | 6058 |
| 176 | AIT17844 | 176 | 551 | 926, 1301, 1676, 2051, 2426, 2801, 3176 | 5003 | 5531 | 6059 |
| 177 | AMR44577 | 177 | 552 | 927, 1302, 1677, 2052, 2427, 2802, 3177 | 5004 | 5532 | 6060 |
| 178 | ANH09722 | 178 | 553 | 928, 1303, 1678, 2053, 2428, 2803, 3178 | 5005 | 5533 | 6061 |
| 179 | ANH09724 | 179 | 554 | 929, 1304, 1679, 2054, 2429, 2804, 3179 | 5006 | 5534 | 6062 |
| 180 | ANH09728 | 180 | 555 | 930, 1305, 1680, 2055, 2430, 2805, 3180 | 5007 | 5535 | 6063 |

TABLE 1-continued

Lassa virus Glycoprotein (GPC)

| Row | column 1 NCBI Accession No. | column 2 A | column 3 B | column 4 C | column 5 D | column 6 E | column 7 F |
|---|---|---|---|---|---|---|---|
| 181 | ANH09730 | 181 | 556 | 931, 1306, 1681, 2056, 2431, 2806, 3181 | 5008 | 5536 | 6064 |
| 182 | ANH09732 | 182 | 557 | 932, 1307, 1682, 2057, 2432, 2807, 3182 | 5009 | 5537 | 6065 |
| 183 | ANH09738 | 183 | 558 | 933, 1308, 1683, 2058, 2433, 2808, 3183 | 5010 | 5538 | 6066 |
| 184 | ANH09740 | 184 | 559 | 934, 1309, 1684, 2059, 2434, 2809, 3184 | 5011 | 5539 | 6067 |
| 185 | CAA36645 | 185 | 560 | 935, 1310, 1685, 2060, 2435, 2810, 3185 | 5012 | 5540 | 6068 |
| 186 | NP_694870 | 186 | 561 | 936, 1311, 1686, 2061, 2436, 2811, 3186 | 5013 | 5541 | 6069 |

TABLE 2

Lassa virus Nucleoprotein (NP)

| Row | column 1 NCBI Accession No. | column 2 A | column 3 B | column 4 C | column 5 D | column 6 E | column 7 F |
|---|---|---|---|---|---|---|---|
| 1 | AAA46284 | 187 | 562 | 937, 1312, 1687, 2062, 2437, 2812, 3187 | 5014 | 5542 | 6070 |
| 2 | AAF86704 | 188 | 563 | 938, 1313, 1688, 2063, 2438, 2813, 3188 | 5015 | 5543 | 6071 |
| 3 | AAO59513 | 189 | 564 | 939, 1314, 1689, 2064, 2439, 2814, 3189 | 5016 | 5544 | 6072 |
| 4 | AAT48999 | 190 | 565 | 940, 1315, 1690, 2065, 2440, 2815, 3190 | 5017 | 5545 | 6073 |
| 5 | AAT49007 | 191 | 566 | 941, 1316, 1691, 2066, 2441, 2816, 3191 | 5018 | 5546 | 6074 |
| 6 | AAT49009 | 192 | 567 | 942, 1317, 1692, 2067, 2442, 2817, 3192 | 5019 | 5547 | 6075 |
| 7 | ADI39452 | 193 | 568 | 943, 1318, 1693, 2068, 2443, 2818, 3193 | 5020 | 5548 | 6076 |
| 8 | ADU56611 | 194 | 569 | 944, 1319, 1694, 2069, 2444, 2819, 3194 | 5021 | 5549 | 6077 |
| 9 | ADU56615 | 195 | 570 | 945, 1320, 1695, 2070, 2445, 2820, 3195 | 5022 | 5550 | 6078 |
| 10 | ADU56619 | 196 | 571 | 946, 1321, 1696, 2071, 2446, 2821, 3196 | 5023 | 5551 | 6079 |
| 11 | ADU56623 | 197 | 572 | 947, 1322, 1697, 2072, 2447, 2822, 3197 | 5024 | 5552 | 6080 |
| 12 | ADU56627 | 198 | 573 | 948, 1323, 1698, 2073, 2448, 2823, 3198 | 5025 | 5553 | 6081 |
| 13 | ADU56631 | 199 | 574 | 949, 1324, 1699, 2074, 2449, 2824, 3199 | 5026 | 5554 | 6082 |
| 14 | AFY05580 | 200 | 575 | 950, 1325, 1700, 2075, 2450, 2825, 3200 | 5027 | 5555 | 6083 |
| 15 | AFY05581 | 201 | 576 | 951, 1326, 1701, 2076, 2451, 2826, 3201 | 5028 | 5556 | 6084 |
| 16 | AFY05587 | 202 | 577 | 952, 1327, 1702, 2077, 2452, 2827, 3202 | 5029 | 5557 | 6085 |
| 17 | AFY05591 | 203 | 578 | 953, 1328, 1703, 2078, 2453, 2828, 3203 | 5030 | 5558 | 6086 |
| 18 | AFY05597 | 204 | 579 | 954, 1329, 1704, 2079, 2454, 2829, 3204 | 5031 | 5559 | 6087 |
| 19 | AFY05610 | 205 | 580 | 955, 1330, 1705, 2080, 2455, 2830, 3205 | 5032 | 5560 | 6088 |
| 20 | AFY05616 | 206 | 581 | 956, 1331, 1706, 2081, 2456, 2831, 3206 | 5033 | 5561 | 6089 |
| 21 | AFY05618 | 207 | 582 | 957, 1332, 1707, 2082, 2457, 2832, 3207 | 5034 | 5562 | 6090 |
| 22 | AHC95552 | 208 | 583 | 958, 1333, 1708, 2083, 2458, 2833, 3208 | 5035 | 5563 | 6091 |
| 23 | AHC95554 | 209 | 584 | 959, 1334, 1709, 2084, 2459, 2834, 3209 | 5036 | 5564 | 6092 |
| 24 | AHC95556 | 210 | 585 | 960, 1335, 1710, 2085, 2460, 2835, 3210 | 5037 | 5565 | 6093 |

TABLE 2-continued

Lassa virus Nucleoprotein (NP)

| Row | column 1 NCBI Accession No. | column 2 A | column 3 B | column 4 C | column 5 D | column 6 E | column 7 F |
|---|---|---|---|---|---|---|---|
| 25 | AHC95558 | 211 | 586 | 961, 1336, 1711, 2086, 2461, 2836, 3211 | 5038 | 5566 | 6094 |
| 26 | AHC95560 | 212 | 587 | 962, 1337, 1712, 2087, 2462, 2837, 3212 | 5039 | 5567 | 6095 |
| 27 | AIT17127 | 213 | 588 | 963, 1338, 1713, 2088, 2463, 2838, 3213 | 5040 | 5568 | 6096 |
| 28 | AIT17131 | 214 | 589 | 964, 1339, 1714, 2089, 2464, 2839, 3214 | 5041 | 5569 | 6097 |
| 29 | AIT17139 | 215 | 590 | 965, 1340, 1715, 2090, 2465, 2840, 3215 | 5042 | 5570 | 6098 |
| 30 | AIT17143 | 216 | 591 | 966, 1341, 1716, 2091, 2466, 2841, 3216 | 5043 | 5571 | 6099 |
| 31 | AIT17147 | 217 | 592 | 967, 1342, 1717, 2092, 2467, 2842, 3217 | 5044 | 5572 | 6100 |
| 32 | AIT17151 | 218 | 593 | 968, 1343, 1718, 2093, 2468, 2843, 3218 | 5045 | 5573 | 6101 |
| 33 | AIT17155 | 219 | 594 | 969, 1344, 1719, 2094, 2469, 2844, 3219 | 5046 | 5574 | 6102 |
| 34 | AIT17161 | 220 | 595 | 970, 1345, 1720, 2095, 2470, 2845, 3220 | 5047 | 5575 | 6103 |
| 35 | AIT17165 | 221 | 596 | 971, 1346, 1721, 2096, 2471, 2846, 3221 | 5048 | 5576 | 6104 |
| 36 | AIT17169 | 222 | 597 | 972, 1347, 1722, 2097, 2472, 2847, 3222 | 5049 | 5577 | 6105 |
| 37 | AIT17173 | 223 | 598 | 973, 1348, 1723, 2098, 2473, 2848, 3223 | 5050 | 5578 | 6106 |
| 38 | AIT17177 | 224 | 599 | 974, 1349, 1724, 2099, 2474, 2849, 3224 | 5051 | 5579 | 6107 |
| 39 | AIT17181 | 225 | 600 | 975, 1350, 1725, 2100, 2475, 2850, 3225 | 5052 | 5580 | 6108 |
| 40 | AIT17185 | 226 | 601 | 976, 1351, 1726, 2101, 2476, 2851, 3226 | 5053 | 5581 | 6109 |
| 41 | AIT17189 | 227 | 602 | 977, 1352, 1727, 2102, 2477, 2852, 3227 | 5054 | 5582 | 6110 |
| 42 | AIT17193 | 228 | 603 | 978, 1353, 1728, 2103, 2478, 2853, 3228 | 5055 | 5583 | 6111 |
| 43 | AIT17197 | 229 | 604 | 979, 1354, 1729, 2104, 2479, 2854, 3229 | 5056 | 5584 | 6112 |
| 44 | AIT17201 | 230 | 605 | 980, 1355, 1730, 2105, 2480, 2855, 3230 | 5057 | 5585 | 6113 |
| 45 | AIT17205 | 231 | 606 | 981, 1356, 1731, 2106, 2481, 2856, 3231 | 5058 | 5586 | 6114 |
| 46 | AIT17209 | 232 | 607 | 982, 1357, 1732, 2107, 2482, 2857, 3232 | 5059 | 5587 | 6115 |
| 47 | AIT17211 | 233 | 608 | 983, 1358, 1733, 2108, 2483, 2858, 3233 | 5060 | 5588 | 6116 |
| 48 | AIT17213 | 234 | 609 | 984, 1359, 1734, 2109, 2484, 2859, 3234 | 5061 | 5589 | 6117 |
| 49 | AIT17217 | 235 | 610 | 985, 1360, 1735, 2110, 2485, 2860, 3235 | 5062 | 5590 | 6118 |
| 50 | AIT17225 | 236 | 611 | 986, 1361, 1736, 2111, 2486, 2861, 3236 | 5063 | 5591 | 6119 |
| 51 | AIT17229 | 237 | 612 | 987, 1362, 1737, 2112, 2487, 2862, 3237 | 5064 | 5592 | 6120 |
| 52 | AIT17233 | 238 | 613 | 988, 1363, 1738, 2113, 2488, 2863, 3238 | 5065 | 5593 | 6121 |
| 53 | AIT17237 | 239 | 614 | 989, 1364, 1739, 2114, 2489, 2864, 3239 | 5066 | 5594 | 6122 |
| 54 | AIT17241 | 240 | 615 | 990, 1365, 1740, 2115, 2490, 2865, 3240 | 5067 | 5595 | 6123 |
| 55 | AIT17245 | 241 | 616 | 991, 1366, 1741, 2116, 2491, 2866, 3241 | 5068 | 5596 | 6124 |
| 56 | AIT17247 | 242 | 617 | 992, 1367, 1742, 2117, 2492, 2867, 3242 | 5069 | 5597 | 6125 |
| 57 | AIT17251 | 243 | 618 | 993, 1368, 1743, 2118, 2493, 2868, 3243 | 5070 | 5598 | 6126 |
| 58 | AIT17255 | 244 | 619 | 994, 1369, 1744, 2119, 2494, 2869, 3244 | 5071 | 5599 | 6127 |
| 59 | AIT17259 | 245 | 620 | 995, 1370, 1745, 2120, 2495, 2870, 3245 | 5072 | 5600 | 6128 |
| 60 | AIT17263 | 246 | 621 | 996, 1371, 1746, 2121, 2496, 2871, 3246 | 5073 | 5601 | 6129 |

TABLE 2-continued

Lassa virus Nucleoprotein (NP)

| Row | column 1 NCBI Accession No. | column 2 A | column 3 B | column 4 C | column 5 D | column 6 E | column 7 F |
|---|---|---|---|---|---|---|---|
| 61 | AIT17267 | 247 | 622 | 997, 1372, 1747, 2122, 2497, 2872, 3247 | 5074 | 5602 | 6130 |
| 62 | AIT17271 | 248 | 623 | 998, 1373, 1748, 2123, 2498, 2873, 3248 | 5075 | 5603 | 6131 |
| 63 | AIT17275 | 249 | 624 | 999, 1374, 1749, 2124, 2499, 2874, 3249 | 5076 | 5604 | 6132 |
| 64 | AIT17277 | 250 | 625 | 1000, 1375, 1750, 2125, 2500, 2875, 3250 | 5077 | 5605 | 6133 |
| 65 | AIT17281 | 251 | 626 | 1001, 1376, 1751, 2126, 2501, 2876, 3251 | 5078 | 5606 | 6134 |
| 66 | AIT17285 | 252 | 627 | 1002, 1377, 1752, 2127, 2502, 2877, 3252 | 5079 | 5607 | 6135 |
| 67 | AIT17289 | 253 | 628 | 1003, 1378, 1753, 2128, 2503, 2878, 3253 | 5080 | 5608 | 6136 |
| 68 | AIT17293 | 254 | 629 | 1004, 1379, 1754, 2129, 2504, 2879, 3254 | 5081 | 5609 | 6137 |
| 69 | AIT17295 | 255 | 630 | 1005, 1380, 1755, 2130, 2505, 2880, 3255 | 5082 | 5610 | 6138 |
| 70 | AIT17299 | 256 | 631 | 1006, 1381, 1756, 2131, 2506, 2881, 3256 | 5083 | 5611 | 6139 |
| 71 | AIT17303 | 257 | 632 | 1007, 1382, 1757, 2132, 2507, 2882, 3257 | 5084 | 5612 | 6140 |
| 72 | AIT17307 | 258 | 633 | 1008, 1383, 1758, 2133, 2508, 2883, 3258 | 5085 | 5613 | 6141 |
| 73 | AIT17311 | 259 | 634 | 1009, 1384, 1759, 2134, 2509, 2884, 3259 | 5086 | 5614 | 6142 |
| 74 | AIT17315 | 260 | 635 | 1010, 1385, 1760, 2135, 2510, 2885, 3260 | 5087 | 5615 | 6143 |
| 75 | AIT17319 | 261 | 636 | 1011, 1386, 1761, 2136, 2511, 2886, 3261 | 5088 | 5616 | 6144 |
| 76 | AIT17323 | 262 | 637 | 1012, 1387, 1762, 2137, 2512, 2887, 3262 | 5089 | 5617 | 6145 |
| 77 | AIT17325 | 263 | 638 | 1013, 1388, 1763, 2138, 2513, 2888, 3263 | 5090 | 5618 | 6146 |
| 78 | AIT17329 | 264 | 639 | 1014, 1389, 1764, 2139, 2514, 2889, 3264 | 5091 | 5619 | 6147 |
| 79 | AIT17333 | 265 | 640 | 1015, 1390, 1765, 2140, 2515, 2890, 3265 | 5092 | 5620 | 6148 |
| 80 | AIT17335 | 266 | 641 | 1016, 1391, 1766, 2141, 2516, 2891, 3266 | 5093 | 5621 | 6149 |
| 81 | AIT17341 | 267 | 642 | 1017, 1392, 1767, 2142, 2517, 2892, 3267 | 5094 | 5622 | 6150 |
| 82 | AIT17345 | 268 | 643 | 1018, 1393, 1768, 2143, 2518, 2893, 3268 | 5095 | 5623 | 6151 |
| 83 | AIT17351 | 269 | 644 | 1019, 1394, 1769, 2144, 2519, 2894, 3269 | 5096 | 5624 | 6152 |
| 84 | AIT17359 | 270 | 645 | 1020, 1395, 1770, 2145, 2520, 2895, 3270 | 5097 | 5625 | 6153 |
| 85 | AIT17361 | 271 | 646 | 1021, 1396, 1771, 2146, 2521, 2896, 3271 | 5098 | 5626 | 6154 |
| 86 | AIT17365 | 272 | 647 | 1022, 1397, 1772, 2147, 2522, 2897, 3272 | 5099 | 5627 | 6155 |
| 87 | AIT17371 | 273 | 648 | 1023, 1398, 1773, 2148, 2523, 2898, 3273 | 5100 | 5628 | 6156 |
| 88 | AIT17379 | 274 | 649 | 1024, 1399, 1774, 2149, 2524, 2899, 3274 | 5101 | 5629 | 6157 |
| 89 | AIT17381 | 275 | 650 | 1025, 1400, 1775, 2150, 2525, 2900, 3275 | 5102 | 5630 | 6158 |
| 90 | AIT17389 | 276 | 651 | 1026, 1401, 1776, 2151, 2526, 2901, 3276 | 5103 | 5631 | 6159 |
| 91 | AIT17399 | 277 | 652 | 1027, 1402, 1777, 2152, 2527, 2902, 3277 | 5104 | 5632 | 6160 |
| 92 | AIT17405 | 278 | 653 | 1028, 1403, 1778, 2153, 2528, 2903, 3278 | 5105 | 5633 | 6161 |
| 93 | AIT17409 | 279 | 654 | 1029, 1404, 1779, 2154, 2529, 2904, 3279 | 5106 | 5634 | 6162 |
| 94 | AIT17413 | 280 | 655 | 1030, 1405, 1780, 2155, 2530, 2905, 3280 | 5107 | 5635 | 6163 |
| 95 | AIT17421 | 281 | 656 | 1031, 1406, 1781, 2156, 2531, 2906, 3281 | 5108 | 5636 | 6164 |
| 96 | AIT17425 | 282 | 657 | 1032, 1407, 1782, 2157, 2532, 2907, 3282 | 5109 | 5637 | 6165 |

TABLE 2-continued

Lassa virus Nucleoprotein (NP)

| Row | column 1 NCBI Accession No. | column 2 A | column 3 B | column 4 C | column 5 D | column 6 E | column 7 F |
|---|---|---|---|---|---|---|---|
| 97 | AIT17429 | 283 | 658 | 1033, 1408, 1783, 2158, 2533, 2908, 3283 | 5110 | 5638 | 6166 |
| 98 | AIT17431 | 284 | 659 | 1034, 1409, 1784, 2159, 2534, 2909, 3284 | 5111 | 5639 | 6167 |
| 99 | AIT17439 | 285 | 660 | 1035, 1410, 1785, 2160, 2535, 2910, 3285 | 5112 | 5640 | 6168 |
| 100 | AIT17443 | 286 | 661 | 1036, 1411, 1786, 2161, 2536, 2911, 3286 | 5113 | 5641 | 6169 |
| 101 | AIT17447 | 287 | 662 | 1037, 1412, 1787, 2162, 2537, 2912, 3287 | 5114 | 5642 | 6170 |
| 102 | AIT17451 | 288 | 663 | 1038, 1413, 1788, 2163, 2538, 2913, 3288 | 5115 | 5643 | 6171 |
| 103 | AIT17455 | 289 | 664 | 1039, 1414, 1789, 2164, 2539, 2914, 3289 | 5116 | 5644 | 6172 |
| 104 | AIT17459 | 290 | 665 | 1040, 1415, 1790, 2165, 2540, 2915, 3290 | 5117 | 5645 | 6173 |
| 105 | AIT17463 | 291 | 666 | 1041, 1416, 1791, 2166, 2541, 2916, 3291 | 5118 | 5646 | 6174 |
| 106 | AIT17467 | 292 | 667 | 1042, 1417, 1792, 2167, 2542, 2917, 3292 | 5119 | 5647 | 6175 |
| 107 | AIT17471 | 293 | 668 | 1043, 1418, 1793, 2168, 2543, 2918, 3293 | 5120 | 5648 | 6176 |
| 108 | AIT17475 | 294 | 669 | 1044, 1419, 1794, 2169, 2544, 2919, 3294 | 5121 | 5649 | 6177 |
| 109 | AIT17479 | 295 | 670 | 1045, 1420, 1795, 2170, 2545, 2920, 3295 | 5122 | 5650 | 6178 |
| 110 | AIT17491 | 296 | 671 | 1046, 1421, 1796, 2171, 2546, 2921, 3296 | 5123 | 5651 | 6179 |
| 111 | AIT17495 | 297 | 672 | 1047, 1422, 1797, 2172, 2547, 2922, 3297 | 5124 | 5652 | 6180 |
| 112 | AIT17499 | 298 | 673 | 1048, 1423, 1798, 2173, 2548, 2923, 3298 | 5125 | 5653 | 6181 |
| 113 | AIT17503 | 299 | 674 | 1049, 1424, 1799, 2174, 2549, 2924, 3299 | 5126 | 5654 | 6182 |
| 114 | AIT17507 | 300 | 675 | 1050, 1425, 1800, 2175, 2550, 2925, 3300 | 5127 | 5655 | 6183 |
| 115 | AIT17511 | 301 | 676 | 1051, 1426, 1801, 2176, 2551, 2926, 3301 | 5128 | 5656 | 6184 |
| 116 | AIT17515 | 302 | 677 | 1052, 1427, 1802, 2177, 2552, 2927, 3302 | 5129 | 5657 | 6185 |
| 117 | AIT17519 | 303 | 678 | 1053, 1428, 1803, 2178, 2553, 2928, 3303 | 5130 | 5658 | 6186 |
| 118 | AIT17525 | 304 | 679 | 1054, 1429, 1804, 2179, 2554, 2929, 3304 | 5131 | 5659 | 6187 |
| 119 | AIT17533 | 305 | 680 | 1055, 1430, 1805, 2180, 2555, 2930, 3305 | 5132 | 5660 | 6188 |
| 120 | AIT17539 | 306 | 681 | 1056, 1431, 1806, 2181, 2556, 2931, 3306 | 5133 | 5661 | 6189 |
| 121 | AIT17541 | 307 | 682 | 1057, 1432, 1807, 2182, 2557, 2932, 3307 | 5134 | 5662 | 6190 |
| 122 | AIT17545 | 308 | 683 | 1058, 1433, 1808, 2183, 2558, 2933, 3308 | 5135 | 5663 | 6191 |
| 123 | AIT17549 | 309 | 684 | 1059, 1434, 1809, 2184, 2559, 2934, 3309 | 5136 | 5664 | 6192 |
| 124 | AIT17553 | 310 | 685 | 1060, 1435, 1810, 2185, 2560, 2935, 3310 | 5137 | 5665 | 6193 |
| 125 | AIT17561 | 311 | 686 | 1061, 1436, 1811, 2186, 2561, 2936, 3311 | 5138 | 5666 | 6194 |
| 126 | AIT17565 | 312 | 687 | 1062, 1437, 1812, 2187, 2562, 2937, 3312 | 5139 | 5667 | 6195 |
| 127 | AIT17569 | 313 | 688 | 1063, 1438, 1813, 2188, 2563, 2938, 3313 | 5140 | 5668 | 6196 |
| 128 | AIT17573 | 314 | 689 | 1064, 1439, 1814, 2189, 2564, 2939, 3314 | 5141 | 5669 | 6197 |
| 129 | AIT17577 | 315 | 690 | 1065, 1440, 1815, 2190, 2565, 2940, 3315 | 5142 | 5670 | 6198 |
| 130 | AIT17581 | 316 | 691 | 1066, 1441, 1816, 2191, 2566, 2941, 3316 | 5143 | 5671 | 6199 |
| 131 | AIT17589 | 317 | 692 | 1067, 1442, 1817, 2192, 2567, 2942, 3317 | 5144 | 5672 | 6200 |
| 132 | AIT17593 | 318 | 693 | 1068, 1443, 1818, 2193, 2568, 2943, 3318 | 5145 | 5673 | 6201 |

TABLE 2-continued

Lassa virus Nucleoprotein (NP)

| Row | column 1 NCBI Accession No. | column 2 A | column 3 B | column 4 C | column 5 D | column 6 E | column 7 F |
|---|---|---|---|---|---|---|---|
| 133 | AIT17605 | 319 | 694 | 1069, 1444, 1819, 2194, 2569, 2944, 3319 | 5146 | 5674 | 6202 |
| 134 | AIT17609 | 320 | 695 | 1070, 1445, 1820, 2195, 2570, 2945, 3320 | 5147 | 5675 | 6203 |
| 135 | AIT17613 | 321 | 696 | 1071, 1446, 1821, 2196, 2571, 2946, 3321 | 5148 | 5676 | 6204 |
| 136 | AIT17617 | 322 | 697 | 1072, 1447, 1822, 2197, 2572, 2947, 3322 | 5149 | 5677 | 6205 |
| 137 | AIT17621 | 323 | 698 | 1073, 1448, 1823, 2198, 2573, 2948, 3323 | 5150 | 5678 | 6206 |
| 138 | AIT17625 | 324 | 699 | 1074, 1449, 1824, 2199, 2574, 2949, 3324 | 5151 | 5679 | 6207 |
| 139 | AIT17627 | 325 | 700 | 1075, 1450, 1825, 2200, 2575, 2950, 3325 | 5152 | 5680 | 6208 |
| 140 | AIT17631 | 326 | 701 | 1076, 1451, 1826, 2201, 2576, 2951, 3326 | 5153 | 5681 | 6209 |
| 141 | AIT17635 | 327 | 702 | 1077, 1452, 1827, 2202, 2577, 2952, 3327 | 5154 | 5682 | 6210 |
| 142 | AIT17639 | 328 | 703 | 1078, 1453, 1828, 2203, 2578, 2953, 3328 | 5155 | 5683 | 6211 |
| 143 | AIT17643 | 329 | 704 | 1079, 1454, 1829, 2204, 2579, 2954, 3329 | 5156 | 5684 | 6212 |
| 144 | AIT17651 | 330 | 705 | 1080, 1455, 1830, 2205, 2580, 2955, 3330 | 5157 | 5685 | 6213 |
| 145 | AIT17655 | 331 | 706 | 1081, 1456, 1831, 2206, 2581, 2956, 3331 | 5158 | 5686 | 6214 |
| 146 | AIT17659 | 332 | 707 | 1082, 1457, 1832, 2207, 2582, 2957, 3332 | 5159 | 5687 | 6215 |
| 147 | AIT17663 | 333 | 708 | 1083, 1458, 1833, 2208, 2583, 2958, 3333 | 5160 | 5688 | 6216 |
| 148 | AIT17667 | 334 | 709 | 1084, 1459, 1834, 2209, 2584, 2959, 3334 | 5161 | 5689 | 6217 |
| 149 | AIT17671 | 335 | 710 | 1085, 1460, 1835, 2210, 2585, 2960, 3335 | 5162 | 5690 | 6218 |
| 150 | AIT17675 | 336 | 711 | 1086, 1461, 1836, 2211, 2586, 2961, 3336 | 5163 | 5691 | 6219 |
| 151 | AIT17679 | 337 | 712 | 1087, 1462, 1837, 2212, 2587, 2962, 3337 | 5164 | 5692 | 6220 |
| 152 | AIT17683 | 338 | 713 | 1088, 1463, 1838, 2213, 2588, 2963, 3338 | 5165 | 5693 | 6221 |
| 153 | AIT17687 | 339 | 714 | 1089, 1464, 1839, 2214, 2589, 2964, 3339 | 5166 | 5694 | 6222 |
| 154 | AIT17695 | 340 | 715 | 1090, 1465, 1840, 2215, 2590, 2965, 3340 | 5167 | 5695 | 6223 |
| 155 | AIT17705 | 341 | 716 | 1091, 1466, 1841, 2216, 2591, 2966, 3341 | 5168 | 5696 | 6224 |
| 156 | AIT17711 | 342 | 717 | 1092, 1467, 1842, 2217, 2592, 2967, 3342 | 5169 | 5697 | 6225 |
| 157 | AIT17713 | 343 | 718 | 1093, 1468, 1843, 2218, 2593, 2968, 3343 | 5170 | 5698 | 6226 |
| 158 | AIT17719 | 344 | 719 | 1094, 1469, 1844, 2219, 2594, 2969, 3344 | 5171 | 5699 | 6227 |
| 159 | AIT17725 | 345 | 720 | 1095, 1470, 1845, 2220, 2595, 2970, 3345 | 5172 | 5700 | 6228 |
| 160 | AIT17729 | 346 | 721 | 1096, 1471, 1846, 2221, 2596, 2971, 3346 | 5173 | 5701 | 6229 |
| 161 | AIT17733 | 347 | 722 | 1097, 1472, 1847, 2222, 2597, 2972, 3347 | 5174 | 5702 | 6230 |
| 162 | AIT17745 | 348 | 723 | 1098, 1473, 1848, 2223, 2598, 2973, 3348 | 5175 | 5703 | 6231 |
| 163 | AIT17753 | 349 | 724 | 1099, 1474, 1849, 2224, 2599, 2974, 3349 | 5176 | 5704 | 6232 |
| 164 | AIT17763 | 350 | 725 | 1100, 1475, 1850, 2225, 2600, 2975, 3350 | 5177 | 5705 | 6233 |
| 165 | AIT17771 | 351 | 726 | 1101, 1476, 1851, 2226, 2601, 2976, 3351 | 5178 | 5706 | 6234 |
| 166 | AIT17779 | 352 | 727 | 1102, 1477, 1852, 2227, 2602, 2977, 3352 | 5179 | 5707 | 6235 |
| 167 | AIT17783 | 353 | 728 | 1103, 1478, 1853, 2228, 2603, 2978, 3353 | 5180 | 5708 | 6236 |
| 168 | AIT17787 | 354 | 729 | 1104, 1479, 1854, 2229, 2604, 2979, 3354 | 5181 | 5709 | 6237 |

TABLE 2-continued

Lassa virus Nucleoprotein (NP)

| Row | column 1 NCBI Accession No. | column 2 A | column 3 B | column 4 C | column 5 D | column 6 E | column 7 F |
|---|---|---|---|---|---|---|---|
| 169 | AIT17803 | 355 | 730 | 1105, 1480, 1855, 2230, 2605, 2980, 3355 | 5182 | 5710 | 6238 |
| 170 | AIT17811 | 356 | 731 | 1106, 1481, 1856, 2231, 2606, 2981, 3356 | 5183 | 5711 | 6239 |
| 171 | AIT17815 | 357 | 732 | 1107, 1482, 1857, 2232, 2607, 2982, 3357 | 5184 | 5712 | 6240 |
| 172 | AIT17821 | 358 | 733 | 1108, 1483, 1858, 2233, 2608, 2983, 3358 | 5185 | 5713 | 6241 |
| 173 | AIT17837 | 359 | 734 | 1109, 1484, 1859, 2234, 2609, 2984, 3359 | 5186 | 5714 | 6242 |
| 174 | AIT17841 | 360 | 735 | 1110, 1485, 1860, 2235, 2610, 2985, 3360 | 5187 | 5715 | 6243 |
| 175 | AIT17845 | 361 | 736 | 1111, 1486, 1861, 2236, 2611, 2986, 3361 | 5188 | 5716 | 6244 |
| 176 | ANH09723 | 362 | 737 | 1112, 1487, 1862, 2237, 2612, 2987, 3362 | 5189 | 5717 | 6245 |
| 177 | ANH09725 | 363 | 738 | 1113, 1488, 1863, 2238, 2613, 2988, 3363 | 5190 | 5718 | 6246 |
| 178 | ANH09729 | 364 | 739 | 1114, 1489, 1864, 2239, 2614, 2989, 3364 | 5191 | 5719 | 6247 |
| 179 | ANH09731 | 365 | 740 | 1115, 1490, 1865, 2240, 2615, 2990, 3365 | 5192 | 5720 | 6248 |
| 180 | ANH09733 | 366 | 741 | 1116, 1491, 1866, 2241, 2616, 2991, 3366 | 5193 | 5721 | 6249 |
| 181 | ANH09735 | 367 | 742 | 1117, 1492, 1867, 2242, 2617, 2992, 3367 | 5194 | 5722 | 6250 |
| 182 | ANH09737 | 368 | 743 | 1118, 1493, 1868, 2243, 2618, 2993, 3368 | 5195 | 5723 | 6251 |
| 183 | ANH09739 | 369 | 744 | 1119, 1494, 1869, 2244, 2619, 2994, 3369 | 5196 | 5724 | 6252 |
| 184 | ANH09741 | 370 | 745 | 1120, 1495, 1870, 2245, 2620, 2995, 3370 | 5197 | 5725 | 6253 |
| 185 | CAA36646 | 371 | 746 | 1121, 1496, 1871, 2246, 2621, 2996, 3371 | 5198 | 5726 | 6254 |
| 186 | CCA30315 | 372 | 747 | 1122, 1497, 1872, 2247, 2622, 2997, 3372 | 5199 | 5727 | 6255 |
| 187 | JX985061 | 373 | 748 | 1123, 1498, 1873, 2248, 2623, 2998, 3373 | 5200 | 5728 | 6256 |
| 188 | NP_694869 | 374 | 749 | 1124, 1499, 1874, 2249, 2624, 2999, 3374 | 5201 | 5729 | 6257 |
| 189 | SCA79106 | 375 | 750 | 1125, 1500, 1875, 2250, 2625, 3000, 3375 | 5202 | 5730 | 6258 |

TABLE 3

Zinc-binding matrix protein (Z)

| Row | column 1 NCBI Accession No. | column 2 A | column 3 B | column 4 C | column 5 D | column 6 E | column 7 F |
|---|---|---|---|---|---|---|---|
| 1 | ADY11072 | 3451 | 3604 | 3757, 3910, 4063, 4216, 4369, 4522, 4675 | 5203 | 5731 | 6259 |
| 2 | AAO59514 | 3452 | 3605 | 3758, 3911, 4064, 4217, 4370, 4523, 4676 | 5204 | 5732 | 6260 |
| 3 | AAO59508 | 3453 | 3606 | 3759, 3912, 4065, 4218, 4371, 4524, 4677 | 5205 | 5733 | 6261 |
| 4 | AAO59510 | 3454 | 3607 | 3760, 3913, 4066, 4219, 4372, 4525, 4678 | 5206 | 5734 | 6262 |
| 5 | AAT48997 | 3455 | 3608 | 3761, 3914, 4067, 4220, 4373, 4526, 4679 | 5207 | 5735 | 6263 |
| 6 | AAT49005 | 3456 | 3609 | 3762, 3915, 4068, 4221, 4374, 4527, 4680 | 5208 | 5736 | 6264 |
| 7 | ADU56612 | 3457 | 3610 | 3763, 3916, 4069, 4222, 4375, 4528, 4681 | 5209 | 5737 | 6265 |
| 8 | ADU56616 | 3458 | 3611 | 3764, 3917, 4070, 4223, 4376, 4529, 4682 | 5210 | 5738 | 6266 |
| 9 | ADU56620 | 3459 | 3612 | 3765, 3918, 4071, 4224, 4377, 4530, 4683 | 5211 | 5739 | 6267 |

TABLE 3-continued

Zinc-binding matrix protein (Z)

| Row | column 1 NCBI Accession No. | column 2 A | column 3 B | column 4 C | column 5 D | column 6 E | column 7 F |
|---|---|---|---|---|---|---|---|
| 10 | ADU56624 | 3460 | 3613 | 3766, 3919, 4072, 4225, 4378, 4531, 4684 | 5212 | 5740 | 6268 |
| 11 | ADU56628 | 3461 | 3614 | 3767, 3920, 4073, 4226, 4379, 4532, 4685 | 5213 | 5741 | 6269 |
| 12 | ADU56632 | 3462 | 3615 | 3768, 3921, 4074, 4227, 4380, 4533, 4686 | 5214 | 5742 | 6270 |
| 13 | ADU56644 | 3463 | 3616 | 3769, 3922, 4075, 4228, 4381, 4534, 4687 | 5215 | 5743 | 6271 |
| 14 | AHC95545 | 3464 | 3617 | 3770, 3923, 4076, 4229, 4382, 4535, 4688 | 5216 | 5744 | 6272 |
| 15 | AHC95547 | 3465 | 3618 | 3771, 3924, 4077, 4230, 4383, 4536, 4689 | 5217 | 5745 | 6273 |
| 16 | AIT17124 | 3466 | 3619 | 3772, 3925, 4078, 4231, 4384, 4537, 4690 | 5218 | 5746 | 6274 |
| 17 | AIT17128 | 3467 | 3620 | 3773, 3926, 4079, 4232, 4385, 4538, 4691 | 5219 | 5747 | 6275 |
| 18 | AIT17132 | 3468 | 3621 | 3774, 3927, 4080, 4233, 4386, 4539, 4692 | 5220 | 5748 | 6276 |
| 19 | AIT17136 | 3469 | 3622 | 3775, 3928, 4081, 4234, 4387, 4540, 4693 | 5221 | 5749 | 6277 |
| 20 | AIT17140 | 3470 | 3623 | 3776, 3929, 4082, 4235, 4388, 4541, 4694 | 5222 | 5750 | 6278 |
| 21 | AIT17144 | 3471 | 3624 | 3777, 3930, 4083, 4236, 4389, 4542, 4695 | 5223 | 5751 | 6279 |
| 22 | AIT17152 | 3472 | 3625 | 3778, 3931, 4084, 4237, 4390, 4543, 4696 | 5224 | 5752 | 6280 |
| 23 | AIT17162 | 3473 | 3626 | 3779, 3932, 4085, 4238, 4391, 4544, 4697 | 5225 | 5753 | 6281 |
| 24 | AIT17166 | 3474 | 3627 | 3780, 3933, 4086, 4239, 4392, 4545, 4698 | 5226 | 5754 | 6282 |
| 25 | AIT17170 | 3475 | 3628 | 3781, 3934, 4087, 4240, 4393, 4546, 4699 | 5227 | 5755 | 6283 |
| 26 | AIT17174 | 3476 | 3629 | 3782, 3935, 4088, 4241, 4394, 4547, 4700 | 5228 | 5756 | 6284 |
| 27 | AIT17178 | 3477 | 3630 | 3783, 3936, 4089, 4242, 4395, 4548, 4701 | 5229 | 5757 | 6285 |
| 28 | AIT17182 | 3478 | 3631 | 3784, 3937, 4090, 4243, 4396, 4549, 4702 | 5230 | 5758 | 6286 |
| 29 | AIT17186 | 3479 | 3632 | 3785, 3938, 4091, 4244, 4397, 4550, 4703 | 5231 | 5759 | 6287 |
| 30 | AIT17194 | 3480 | 3633 | 3786, 3939, 4092, 4245, 4398, 4551, 4704 | 5232 | 5760 | 6288 |
| 31 | AIT17198 | 3481 | 3634 | 3787, 3940, 4093, 4246, 4399, 4552, 4705 | 5233 | 5761 | 6289 |
| 32 | AIT17202 | 3482 | 3635 | 3788, 3941, 4094, 4247, 4400, 4553, 4706 | 5234 | 5762 | 6290 |
| 33 | AIT17206 | 3483 | 3636 | 3789, 3942, 4095, 4248, 4401, 4554, 4707 | 5235 | 5763 | 6291 |
| 34 | AIT17214 | 3484 | 3637 | 3790, 3943, 4096, 4249, 4402, 4555, 4708 | 5236 | 5764 | 6292 |
| 35 | AIT17222 | 3485 | 3638 | 3791, 3944, 4097, 4250, 4403, 4556, 4709 | 5237 | 5765 | 6293 |
| 36 | AIT17226 | 3486 | 3639 | 3792, 3945, 4098, 4251, 4404, 4557, 4710 | 5238 | 5766 | 6294 |
| 37 | AIT17230 | 3487 | 3640 | 3793, 3946, 4099, 4252, 4405, 4558, 4711 | 5239 | 5767 | 6295 |
| 38 | AIT17234 | 3488 | 3641 | 3794, 3947, 4100, 4253, 4406, 4559, 4712 | 5240 | 5768 | 6296 |
| 39 | AIT17238 | 3489 | 3642 | 3795, 3948, 4101, 4254, 4407, 4560, 4713 | 5241 | 5769 | 6297 |
| 40 | AIT17242 | 3490 | 3643 | 3796, 3949, 4102, 4255, 4408, 4561, 4714 | 5242 | 5770 | 6298 |
| 41 | AIT17248 | 3491 | 3644 | 3797, 3950, 4103, 4256, 4409, 4562, 4715 | 5243 | 5771 | 6299 |
| 42 | AIT17252 | 3492 | 3645 | 3798, 3951, 4104, 4257, 4410, 4563, 4716 | 5244 | 5772 | 6300 |
| 43 | AIT17256 | 3493 | 3646 | 3799, 3952, 4105, 4258, 4411, 4564, 4717 | 5245 | 5773 | 6301 |
| 44 | AIT17260 | 3494 | 3647 | 3800, 3953, 4106, 4259, 4412, 4565, 4718 | 5246 | 5774 | 6302 |
| 45 | AIT17268 | 3495 | 3648 | 3801, 3954, 4107, 4260, 4413, 4566, 4719 | 5247 | 5775 | 6303 |

TABLE 3-continued

Zinc-binding matrix protein (Z)

| Row | column 1 NCBI Accession No. | column 2 A | column 3 B | column 4 C | column 5 D | column 6 E | column 7 F |
|---|---|---|---|---|---|---|---|
| 46 | AIT17272 | 3496 | 3649 | 3802, 3955, 4108, 4261, 4414, 4567, 4720 | 5248 | 5776 | 6304 |
| 47 | AIT17278 | 3497 | 3650 | 3803, 3956, 4109, 4262, 4415, 4568, 4721 | 5249 | 5777 | 6305 |
| 48 | AIT17282 | 3498 | 3651 | 3804, 3957, 4110, 4263, 4416, 4569, 4722 | 5250 | 5778 | 6306 |
| 49 | AIT17286 | 3499 | 3652 | 3805, 3958, 4111, 4264, 4417, 4570, 4723 | 5251 | 5779 | 6307 |
| 50 | AIT17290 | 3500 | 3653 | 3806, 3959, 4112, 4265, 4418, 4571, 4724 | 5252 | 5780 | 6308 |
| 51 | AIT17296 | 3501 | 3654 | 3807, 3960, 4113, 4266, 4419, 4572, 4725 | 5253 | 5781 | 6309 |
| 52 | AIT17300 | 3502 | 3655 | 3808, 3961, 4114, 4267, 4420, 4573, 4726 | 5254 | 5782 | 6310 |
| 53 | AIT17312 | 3503 | 3656 | 3809, 3962, 4115, 4268, 4421, 4574, 4727 | 5255 | 5783 | 6311 |
| 54 | AIT17316 | 3504 | 3657 | 3810, 3963, 4116, 4269, 4422, 4575, 4728 | 5256 | 5784 | 6312 |
| 55 | AIT17320 | 3505 | 3658 | 3811, 3964, 4117, 4270, 4423, 4576, 4729 | 5257 | 5785 | 6313 |
| 56 | AIT17326 | 3506 | 3659 | 3812, 3965, 4118, 4271, 4424, 4577, 4730 | 5258 | 5786 | 6314 |
| 57 | AIT17330 | 3507 | 3660 | 3813, 3966, 4119, 4272, 4425, 4578, 4731 | 5259 | 5787 | 6315 |
| 58 | AIT17342 | 3508 | 3661 | 3814, 3967, 4120, 4273, 4426, 4579, 4732 | 5260 | 5788 | 6316 |
| 59 | AIT17346 | 3509 | 3662 | 3815, 3968, 4121, 4274, 4427, 4580, 4733 | 5261 | 5789 | 6317 |
| 60 | AIT17362 | 3510 | 3663 | 3816, 3969, 4122, 4275, 4428, 4581, 4734 | 5262 | 5790 | 6318 |
| 61 | AIT17366 | 3511 | 3664 | 3817, 3970, 4123, 4276, 4429, 4582, 4735 | 5263 | 5791 | 6319 |
| 62 | AIT17376 | 3512 | 3665 | 3818, 3971, 4124, 4277, 4430, 4583, 4736 | 5264 | 5792 | 6320 |
| 63 | AIT17382 | 3513 | 3666 | 3819, 3972, 4125, 4278, 4431, 4584, 4737 | 5265 | 5793 | 6321 |
| 64 | AIT17386 | 3514 | 3667 | 3820, 3973, 4126, 4279, 4432, 4585, 4738 | 5266 | 5794 | 6322 |
| 65 | AIT17396 | 3515 | 3668 | 3821, 3974, 4127, 4280, 4433, 4586, 4739 | 5267 | 5795 | 6323 |
| 66 | AIT17402 | 3516 | 3669 | 3822, 3975, 4128, 4281, 4434, 4587, 4740 | 5268 | 5796 | 6324 |
| 67 | AIT17406 | 3517 | 3670 | 3823, 3976, 4129, 4282, 4435, 4588, 4741 | 5269 | 5797 | 6325 |
| 68 | AIT17410 | 3518 | 3671 | 3824, 3977, 4130, 4283, 4436, 4589, 4742 | 5270 | 5798 | 6326 |
| 69 | AIT17418 | 3519 | 3672 | 3825, 3978, 4131, 4284, 4437, 4590, 4743 | 5271 | 5799 | 6327 |
| 70 | AIT17422 | 3520 | 3673 | 3826, 3979, 4132, 4285, 4438, 4591, 4744 | 5272 | 5800 | 6328 |
| 71 | AIT17426 | 3521 | 3674 | 3827, 3980, 4133, 4286, 4439, 4592, 4745 | 5273 | 5801 | 6329 |
| 72 | AIT17432 | 3522 | 3675 | 3828, 3981, 4134, 4287, 4440, 4593, 4746 | 5274 | 5802 | 6330 |
| 73 | AIT17436 | 3523 | 3676 | 3829, 3982, 4135, 4288, 4441, 4594, 4747 | 5275 | 5803 | 6331 |
| 74 | AIT17444 | 3524 | 3677 | 3830, 3983, 4136, 4289, 4442, 4595, 4748 | 5276 | 5804 | 6332 |
| 75 | AIT17448 | 3525 | 3678 | 3831, 3984, 4137, 4290, 4443, 4596, 4749 | 5277 | 5805 | 6333 |
| 76 | AIT17452 | 3526 | 3679 | 3832, 3985, 4138, 4291, 4444, 4597, 4750 | 5278 | 5806 | 6334 |
| 77 | AIT17456 | 3527 | 3680 | 3833, 3986, 4139, 4292, 4445, 4598, 4751 | 5279 | 5807 | 6335 |
| 78 | AIT17460 | 3528 | 3681 | 3834, 3987, 4140, 4293, 4446, 4599, 4752 | 5280 | 5808 | 6336 |
| 79 | AIT17468 | 3529 | 3682 | 3835, 3988, 4141, 4294, 4447, 4600, 4753 | 5281 | 5809 | 6337 |
| 80 | AIT17472 | 3530 | 3683 | 3836, 3989, 4142, 4295, 4448, 4601, 4754 | 5282 | 5810 | 6338 |
| 81 | AIT17476 | 3531 | 3684 | 3837, 3990, 4143, 4296, 4449, 4602, 4755 | 5283 | 5811 | 6339 |

TABLE 3-continued

Zinc-binding matrix protein (Z)

| Row | column 1 NCBI Accession No. | column 2 A | column 3 B | column 4 C | column 5 D | column 6 E | column 7 F |
|---|---|---|---|---|---|---|---|
| 82 | AIT17480 | 3532 | 3685 | 3838, 3991, 4144, 4297, 4450, 4603, 4756 | 5284 | 5812 | 6340 |
| 83 | AIT17484 | 3533 | 3686 | 3839, 3992, 4145, 4298, 4451, 4604, 4757 | 5285 | 5813 | 6341 |
| 84 | AIT17488 | 3534 | 3687 | 3840, 3993, 4146, 4299, 4452, 4605, 4758 | 5286 | 5814 | 6342 |
| 85 | AIT17496 | 3535 | 3688 | 3841, 3994, 4147, 4300, 4453, 4606, 4759 | 5287 | 5815 | 6343 |
| 86 | AIT17500 | 3536 | 3689 | 3842, 3995, 4148, 4301, 4454, 4607, 4760 | 5288 | 5816 | 6344 |
| 87 | AIT17508 | 3537 | 3690 | 3843, 3996, 4149, 4302, 4455, 4608, 4761 | 5289 | 5817 | 6345 |
| 88 | AIT17512 | 3538 | 3691 | 3844, 3997, 4150, 4303, 4456, 4609, 4762 | 5290 | 5818 | 6346 |
| 89 | AIT17516 | 3539 | 3692 | 3845, 3998, 4151, 4304, 4457, 4610, 4763 | 5291 | 5819 | 6347 |
| 90 | AIT17520 | 3540 | 3693 | 3846, 3999, 4152, 4305, 4458, 4611, 4764 | 5292 | 5820 | 6348 |
| 91 | AIT17526 | 3541 | 3694 | 3847, 4000, 4153, 4306, 4459, 4612, 4765 | 5293 | 5821 | 6349 |
| 92 | AIT17536 | 3542 | 3695 | 3848, 4001, 4154, 4307, 4460, 4613, 4766 | 5294 | 5822 | 6350 |
| 93 | AIT17542 | 3543 | 3696 | 3849, 4002, 4155, 4308, 4461, 4614, 4767 | 5295 | 5823 | 6351 |
| 94 | AIT17546 | 3544 | 3697 | 3850, 4003, 4156, 4309, 4462, 4615, 4768 | 5296 | 5824 | 6352 |
| 95 | AIT17550 | 3545 | 3698 | 3851, 4004, 4157, 4310, 4463, 4616, 4769 | 5297 | 5825 | 6353 |
| 96 | AIT17554 | 3546 | 3699 | 3852, 4005, 4158, 4311, 4464, 4617, 4770 | 5298 | 5826 | 6354 |
| 97 | AIT17558 | 3547 | 3700 | 3853, 4006, 4159, 4312, 4465, 4618, 4771 | 5299 | 5827 | 6355 |
| 98 | AIT17570 | 3548 | 3701 | 3854, 4007, 4160, 4313, 4466, 4619, 4772 | 5300 | 5828 | 6356 |
| 99 | AIT17578 | 3549 | 3702 | 3855, 4008, 4161, 4314, 4467, 4620, 4773 | 5301 | 5829 | 6357 |
| 100 | AIT17586 | 3550 | 3703 | 3856, 4009, 4162, 4315, 4468, 4621, 4774 | 5302 | 5830 | 6358 |
| 101 | AIT17590 | 3551 | 3704 | 3857, 4010, 4163, 4316, 4469, 4622, 4775 | 5303 | 5831 | 6359 |
| 102 | AIT17602 | 3552 | 3705 | 3858, 4011, 4164, 4317, 4470, 4623, 4776 | 5304 | 5832 | 6360 |
| 103 | AIT17610 | 3553 | 3706 | 3859, 4012, 4165, 4318, 4471, 4624, 4777 | 5305 | 5833 | 6361 |
| 104 | AIT17614 | 3554 | 3707 | 3860, 4013, 4166, 4319, 4472, 4625, 4778 | 5306 | 5834 | 6362 |
| 105 | AIT17618 | 3555 | 3708 | 3861, 4014, 4167, 4320, 4473, 4626, 4779 | 5307 | 5835 | 6363 |
| 106 | AIT17622 | 3556 | 3709 | 3862, 4015, 4168, 4321, 4474, 4627, 4780 | 5308 | 5836 | 6364 |
| 107 | AIT17628 | 3557 | 3710 | 3863, 4016, 4169, 4322, 4475, 4628, 4781 | 5309 | 5837 | 6365 |
| 108 | AIT17632 | 3558 | 3711 | 3864, 4017, 4170, 4323, 4476, 4629, 4782 | 5310 | 5838 | 6366 |
| 109 | AIT17636 | 3559 | 3712 | 3865, 4018, 4171, 4324, 4477, 4630, 4783 | 5311 | 5839 | 6367 |
| 110 | AIT17640 | 3560 | 3713 | 3866, 4019, 4172, 4325, 4478, 4631, 4784 | 5312 | 5840 | 6368 |
| 111 | AIT17648 | 3561 | 3714 | 3867, 4020, 4173, 4326, 4479, 4632, 4785 | 5313 | 5841 | 6369 |
| 112 | AIT17652 | 3562 | 3715 | 3868, 4021, 4174, 4327, 4480, 4633, 4786 | 5314 | 5842 | 6370 |
| 113 | AIT17656 | 3563 | 3716 | 3869, 4022, 4175, 4328, 4481, 4634, 4787 | 5315 | 5843 | 6371 |
| 114 | AIT17660 | 3564 | 3717 | 3870, 4023, 4176, 4329, 4482, 4635, 4788 | 5316 | 5844 | 6372 |
| 115 | AIT17664 | 3565 | 3718 | 3871, 4024, 4177, 4330, 4483, 4636, 4789 | 5317 | 5845 | 6373 |
| 116 | AIT17668 | 3566 | 3719 | 3872, 4025, 4178, 4331, 4484, 4637, 4790 | 5318 | 5846 | 6374 |
| 117 | AIT17676 | 3567 | 3720 | 3873, 4026, 4179, 4332, 4485, 4638, 4791 | 5319 | 5847 | 6375 |

TABLE 3-continued

| | Zinc-binding matrix protein (Z) | | | | | | |
|---|---|---|---|---|---|---|---|
| Row | column 1 NCBI Accession No. | column 2 A | column 3 B | column 4 C | column 5 D | column 6 E | column 7 F |
| 118 | AIT17680 | 3568 | 3721 | 3874, 4027, 4180, 4333, 4486, 4639, 4792 | 5320 | 5848 | 6376 |
| 119 | A1117684 | 3569 | 3722 | 3875, 4028, 4181, 4334, 4487, 4640, 4793 | 5321 | 5849 | 6377 |
| 120 | AIT17692 | 3570 | 3723 | 3876, 4029, 4182, 4335, 4488, 4641, 4794 | 5322 | 5850 | 6378 |
| 121 | AIT17702 | 3571 | 3724 | 3877, 4030, 4183, 4336, 4489, 4642, 4795 | 5323 | 5851 | 6379 |
| 122 | AIT17708 | 3572 | 3725 | 3878, 4031, 4184, 4337, 4490, 4643, 4796 | 5324 | 5852 | 6380 |
| 123 | AIT17716 | 3573 | 3726 | 3879, 4032, 4185, 4338, 4491, 4644, 4797 | 5325 | 5853 | 6381 |
| 124 | AIT17720 | 3574 | 3727 | 3880, 4033, 4186, 4339, 4492, 4645, 4798 | 5326 | 5854 | 6382 |
| 125 | AIT17730 | 3575 | 3728 | 3881, 4034, 4187, 4340, 4493, 4646, 4799 | 5327 | 5855 | 6383 |
| 126 | AIT17734 | 3576 | 3729 | 3882, 4035, 4188, 4341, 4494, 4647, 4800 | 5328 | 5856 | 6384 |
| 127 | AIT17738 | 3577 | 3730 | 3883, 4036, 4189, 4342, 4495, 4648, 4801 | 5329 | 5857 | 6385 |
| 128 | AIT17750 | 3578 | 3731 | 3884, 4037, 4190, 4343, 4496, 4649, 4802 | 5330 | 5858 | 6386 |
| 129 | AIT17754 | 3579 | 3732 | 3885, 4038, 4191, 4344, 4497, 4650, 4803 | 5331 | 5859 | 6387 |
| 130 | AIT17760 | 3580 | 3733 | 3886, 4039, 4192, 4345, 4498, 4651, 4804 | 5332 | 5860 | 6388 |
| 131 | AIT17768 | 3581 | 3734 | 3887, 4040, 4193, 4346, 4499, 4652, 4805 | 5333 | 5861 | 6389 |
| 132 | AIT17776 | 3582 | 3735 | 3888, 4041, 4194, 4347, 4500, 4653, 4806 | 5334 | 5862 | 6390 |
| 133 | AIT17780 | 3583 | 3736 | 3889, 4042, 4195, 4348, 4501, 4654, 4807 | 5335 | 5863 | 6391 |
| 134 | AIT17784 | 3584 | 3737 | 3890, 4043, 4196, 4349, 4502, 4655, 4808 | 5336 | 5864 | 6392 |
| 135 | AIT17788 | 3585 | 3738 | 3891, 4044, 4197, 4350, 4503, 4656, 4809 | 5337 | 5865 | 6393 |
| 136 | AIT17792 | 3586 | 3739 | 3892, 4045, 4198, 4351, 4504, 4657, 4810 | 5338 | 5866 | 6394 |
| 137 | AIT17796 | 3587 | 3740 | 3893, 4046, 4199, 4352, 4505, 4658, 4811 | 5339 | 5867 | 6395 |
| 138 | AIT17800 | 3588 | 3741 | 3894, 4047, 4200, 4353, 4506, 4659, 4812 | 5340 | 5868 | 6396 |
| 139 | AIT17804 | 3589 | 3742 | 3895, 4048, 4201, 4354, 4507, 4660, 4813 | 5341 | 5869 | 6397 |
| 140 | AIT17808 | 3590 | 3743 | 3896, 4049, 4202, 4355, 4508, 4661, 4814 | 5342 | 5870 | 6398 |
| 141 | AIT17834 | 3591 | 3744 | 3897, 4050, 4203, 4356, 4509, 4662, 4815 | 5343 | 5871 | 6399 |
| 142 | AIT17838 | 3592 | 3745 | 3898, 4051, 4204, 4357, 4510, 4663, 4816 | 5344 | 5872 | 6400 |
| 143 | AIT17842 | 3593 | 3746 | 3899, 4052, 4205, 4358, 4511, 4664, 4817 | 5345 | 5873 | 6401 |
| 144 | ANH09743 | 3594 | 3747 | 3900, 4053, 4206, 4359, 4512, 4665, 4818 | 5346 | 5874 | 6402 |
| 145 | ANH09745 | 3595 | 3748 | 3901, 4054, 4207, 4360, 4513, 4666, 4819 | 5347 | 5875 | 6403 |
| 146 | ANH09749 | 3596 | 3749 | 3902, 4055, 4208, 4361, 4514, 4667, 4820 | 5348 | 5876 | 6404 |
| 147 | ANH09751 | 3597 | 3750 | 3903, 4056, 4209, 4362, 4515, 4668, 4821 | 5349 | 5877 | 6405 |
| 148 | ANH09753 | 3598 | 3751 | 3904, 4057, 4210, 4363, 4516, 4669, 4822 | 5350 | 5878 | 6406 |
| 149 | ANH09755 | 3599 | 3752 | 3905, 4058, 4211, 4364, 4517, 4670, 4823 | 5351 | 5879 | 6407 |
| 150 | ANH09759 | 3600 | 3753 | 3906, 4059, 4212, 4365, 4518, 4671, 4824 | 5352 | 5880 | 6408 |
| 151 | ANH09761 | 3601 | 3754 | 3907, 4060, 4213, 4366, 4519, 4672, 4825 | 5353 | 5881 | 6409 |
| 152 | AMR44579 | 3602 | 3755 | 3908, 4061, 4214, 4367, 4520, 4673, 4826 | 5354 | 5882 | 6410 |
| 153 | AMZ00378 | 3603 | 3756 | 3909, 4062, 4215, 4368, 4521, 4674, 4827 | 5355 | 5883 | 6411 |

Preferred Lassa virus polypeptide, nucleic acid and mRNA sequences are provided in Table 1, 2 and 3. Therein, each row represents a specific suitable Lassa virus construct of the invention. The protein design/name is indicated for each row (column "Name"). Therein, each row corresponds to a glycoprotein precursor (GPC) (Table 1) or nucleoprotein (NP) (Table 2) or nucleoprotein (NP) zinc-binding matrix protein (Z) (Table 3) as identified by the database accession number of the corresponding protein (first column "NCBI Accession No."). The second column in Table 1, 2 or 3 ("A") indicates the SEQ ID NO: corresponding to the respective amino acid sequence as provided herein. The SEQ ID NO: corresponding to the nucleic acid sequence of the wild type mRNA encoding the protein is indicated in the third column ("B"). The fourth column ("C") provides the SEQ ID NO:'s corresponding to modified/optimized nucleic acid sequences of the mRNAs as described herein that encode the protein preferably having the amino acid sequence as defined by the SEQ ID NO: indicated in the second column ("A") or by the database entry indicated in the first column. mRNA constructs comprising coding sequences encoding said proteins are provided in column 5 "D" "SEQ ID NO: mRNA design 1" column 6 "E" "SEQ ID NO: mRNA design 2" and column 7 "E" "SEQ ID NO: mRNA design 3". Additional information regarding each of the sequences provided in Table 1, 2 and 3 may also be derived from the sequence listing, in particular from the details provided therein under identifier <223>.

Wild Type Antigenic Proteins

In preferred embodiments, the inventive mRNA comprises at least one coding region encoding at least one full-length, wild type protein derived from a lassa virus, preferably a full-length, wild type glycoprotein precursor (GPC) derived from a lassa virus, said glycoprotein precursor (GPC) preferably comprising or consisting of an amino acid sequence as defined by the database accession number listed in Table 1, or preferably by any one of SEQ ID NO: 1-186 (see Table 1, column, A").

In preferred embodiments, the inventive mRNA comprises at least one coding region encoding at least one full-length, wild type protein derived from a lassa virus, preferably a full-length, wild type nucleoprotein (NP) derived from a lassa virus, said nucleoprotein (NP) preferably comprising or consisting of an amino acid sequence as defined by the database accession number listed in Table 2, or preferably by any one of SEQ ID NO: 187-375 (see Table 2, column A").

In preferred embodiments, the inventive mRNA comprises at least one coding region encoding at least one full-length, wild type protein derived from a lassa virus, preferably a full-length, wild type zinc-binding matrix protein (Z) derived from a lassa virus, said zinc-binding matrix protein (Z) preferably comprising or consisting of an amino acid sequence as defined by the database accession number listed in Table 3, or preferably by any one of SEQ ID NO: 3451-3603 (see Table 3, column, A").

A full-length "naturally occurring (wild type)" protein may be encoded by a naturally occurring (wild type) nucleic acid sequence, in particular RNA sequence, or (due to the degeneracy of the genetic code) by a nucleic acid sequence "variant". Thus, in preferred embodiments, the inventive mRNA, and in particular its at least one coding region, comprises a wild type RNA sequence or an RNA sequence variant encoding a full-length, wild type protein as defined herein.

Accordingly, the at least one coding sequence of the inventive mRNA may preferably comprise or consist of a wild type RNA sequence encoding a full-length, wild type protein as defined herein.

In preferred embodiments, the inventive mRNA comprises at least one coding region encoding a full-length, wild type glycoprotein precursor (GPC) derived from a lassa virus, said mRNA (in particular its at least one coding region) comprising or consisting of an RNA sequence as defined by SEQ ID NOs: 376-561 (see Table 1, column B") or a variant of any of these sequences.

In preferred embodiments, the inventive mRNA comprises at least one coding region encoding a full-length, wild type nucleoprotein (NP) derived from a lassa virus, said mRNA (in particular its at least one coding region) comprising or consisting of an RNA sequence as defined by SEQ ID NOs: 562-750 (see Table 2, column B") or a variant of any of these sequences.

In preferred embodiments, the inventive mRNA comprises at least one coding region encoding a full-length, wild type zinc-binding matrix protein (Z) derived from a lassa virus, said mRNA (in particular its at least one coding region) comprising or consisting of an RNA sequence as defined by SEQ ID NOs: 3604-3756 (see Table 3, column B") or a variant of any of these sequences.

In this context, a "variant" RNA sequence differs from the respective wild type RNA sequence in at least one nucleic acid residue, preferably without resulting (due to the degenerated genetic code) in an alteration of the encoded amino acid sequence. According to a preferred embodiment, said "variant" RNA sequence encoding a full-length, wild type protein comprises or consists of an RNA sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97% with an RNA sequence encoding said full-length, wild type protein, preferably an RNA sequence according to SEQ ID NO: 376-561 (encoding a GPC or a variant thereof) or an RNA sequence according to SEQ ID NO: 562-750 (encoding an NP or a variant thereof) or an RNA sequence according to SEQ ID NO: 3604-3756 (encoding an Z or a variant thereof).

Variant Antigenic Proteins

In preferred embodiments, the inventive mRNA comprises at least one coding region encoding at least one full-length wild type protein derived from a lassa virus, preferably a full-length, "variant" glycoprotein precursor (GPC) and/or a full-length, "variant" nucleoprotein (NP) and/or a full-length, "variant" zinc-binding matrix protein (Z) comprising or consisting of a "variant" amino acid sequence of the sequences as defined by the database accession number provided under the respective column in Table 1, 2 or 3 (column A"), and more preferably comprising or consisting of a "variant" amino acid sequence of the sequences as defined by the SEQ ID NOs: 1-186 (GPC) or SEQ ID NOs: 187-375 (NP) or SEQ ID NOs: 3451-3603 (Z).

Preferably, the sequence of a protein "variant" or "sequence variant" differs in at least one amino acid residue from the amino acid sequence of the naturally occurring (wild type) protein serving as a reference (or "parent") sequence. Variant proteins thus preferably comprise at least one amino acid mutation, substitution, insertion or deletion as compared to their respective reference sequence. Preferably, the term "variant" as used herein comprises any homolog, isoform or transcript variant of a protein as defined herein, wherein the homolog, isoform or transcript variant is preferably characterized by a degree of identity or homology, respectively, as defined herein.

A protein "variant" encoded by the at least one coding sequence of the inventive mRNA may comprise at least one amino acid substitution as compared to the wild type (naturally occurring) antigen amino acid sequence. Said substitution may be selected from a conservative or non-conservative substitution. In some embodiments, it is preferred that a protein "variant" encoded by the at least one coding sequence of the inventive mRNA comprises at least one conservative amino acid substitution, wherein amino acids, which originate from the same class, are exchanged for one another. In particular, these are amino acids having aliphatic side chains, positively or negatively charged side chains, aromatic groups in the side chains or amino acids, the side chains of which can form hydrogen bridges, e.g. side chains which have a hydroxyl function. By conservative constitution, e.g. an amino acid having a polar side chain may be replaced by another amino acid having a corresponding polar side chain, or, for example, an amino acid characterized by a hydrophobic side chain may be substituted by another amino acid having a corresponding hydrophobic side chain (e.g. serine (threonine) by threonine (serine) or leucine (isoleucine) by isoleucine (leucine)). The protein "variant" may also comprise amino acid mutations, insertions, deletions and/or non-conservative substitutions, in particular, at those sequence positions, which do not impair the functionality of the epitope(s) of the encoded antigenic protein(s).

Accordingly, in preferred embodiments, the inventive mRNA comprises at least one coding region encoding at least one "variant" protein derived from a lassa virus, preferably a variant glycoprotein precursor (GPC) derived from a lassa virus, said glycoprotein precursor (GPC) preferably comprising or consisting of a "variant" amino acid sequence of the sequences as defined by any one of SEQ ID NOs: 1-186, wherein said "variant" preferably comprises or consists of an amino acid sequence having sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably of at least 90% and most preferably of at least 95% or even 97% to any one of the sequences as defined by SEQ ID NOs: 1-186.

In preferred embodiments, the inventive mRNA comprises at least one coding region encoding at least one "variant" protein derived from a lassa virus, preferably a variant nucleoprotein (NP) derived from a lassa virus, said nucleoprotein (NP) preferably comprising or consisting of a "variant" amino acid sequence of the sequences as defined by any one of SEQ ID NO: 187-375, wherein said "variant" preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97% to any one of the sequences as defined by SEQ ID NOs: 187-375.

In preferred embodiments, the inventive mRNA comprises at least one coding region encoding at least one "variant" protein derived from a lassa virus, preferably a variant zinc-binding matrix protein (Z) derived from a lassa virus, said zinc-binding matrix protein (Z) preferably comprising or consisting of a "variant" amino acid sequence of the sequences as defined by any one of SEQ ID NO: 3451-3603, wherein said "variant" preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97% to any one of the sequences as defined by SEQ ID NOs: 3451-3603.

Such "variant" antigenic proteins or peptides may be encoded by "variant" RNA sequence as defined above.

Accordingly, in preferred embodiments, the inventive mRNA comprises at least one coding region encoding a "variant" glycoprotein precursor (GPC) derived from a lassa virus, said mRNA (in particular its coding region) comprising or consisting of an RNA sequence as defined by SEQ ID NOs: 376-561 or a variant thereof, wherein said "variant" RNA sequence has a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 376-561 or a variant or fragment of any of said sequences.

In preferred embodiments, the inventive mRNA comprises at least one coding region encoding a variant nucleoprotein (NP) derived from a lassa virus, said mRNA (in particular its coding region) comprising or consisting of an RNA sequence as defined by SEQ ID NOs: 562-750 or a variant thereof, wherein said variant RNA sequence has a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 562-750 or a variant or fragment of any of said sequences.

In preferred embodiments, the inventive mRNA comprises at least one coding region encoding a variant zinc-binding matrix protein (Z) derived from a lassa virus, said mRNA (in particular its coding region) comprising or consisting of an RNA sequence as defined by SEQ ID NOs: 3604-3756 or a variant thereof, wherein said variant RNA sequence has a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 3604-3756 or a variant or fragment of any of said sequences.

Fragments of Antigenic Proteins or Variants Thereof

According to further preferred embodiment, the at least one coding sequence of the inventive mRNA encodes a fragment of a protein or a variant thereof as defined herein. Said fragment can be of any length, provided that it preferably comprises or yields at least one functional epitope.

In the context of the present invention, a "fragment" of a protein (or a variant thereof) may comprise a sequence of a protein (or a variant thereof) as defined above, which is, with regard to its amino acid sequence (or its encoded nucleic acid sequence), N-terminally, C-terminally and/or intrasequentially truncated compared to the amino acid sequence of the naturally occurring protein or variant thereof (or its encoded nucleic acid sequence). Such truncation may thus occur either on the amino acid level or on the nucleic acid level, respectively. A sequence identity with respect to such a fragment as defined herein therefore preferably refers to the entire protein (or a variant thereof) as defined herein or to the entire (coding) nucleic acid sequence of such a protein (or a variant thereof).

A preferred "fragment" in the context of the present invention, consists of a continuous stretch of entities, such as nucleotides or amino acids corresponding to a continuous stretch of entities in the molecule the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) molecule from which the fragment is derived.

A "fragment" of a protein (or a variant thereof) may particularly comprise or consist of an amino acid sequence of said protein (or a variant thereof) as defined herein, having a length of about 5 to about 20 or even more amino acids and which is preferably processed and presented by an MHC complex. Preferably, a fragment of a protein (or a variant thereof) may comprise or consist of an amino acid sequence of said protein (or a variant thereof) as defined herein, which has a length of about 6 to about 20 or even more amino acids, e.g. a fragment as processed and presented by MHC class I molecules, preferably having a length of about 8 to about 10 amino acids, e.g. 8, 9, or 10, (or even 6, 7, 11, or 12 amino acids), or a fragment as processed and presented by MHC class II molecules, preferably having a length of about 13 or more amino acids, e.g. 13, 14, 15, 16, 17, 18, 19, 20 or even more amino acids, wherein the fragment may be selected from any part of the amino acid sequence. These fragments are typically recognized by T-cells in the form of a complex consisting of the peptide fragment and an MHC molecule, i.e. the fragments are typically not recognized in their "native" or "free" form, but rather in MHC-bound form.

Preferably, a "fragment" of a protein (or a variant thereof) encoded by the at least one coding sequence of the inventive mRNA may typically comprise or consist of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably of at least 85%, even more preferably of at least 90% and most preferably of at least 95% or even 97%, with an amino acid sequence of an antigenic protein or peptide as defined herein, preferably as defined by the database accession number provided under the respective column in Table 1-3, and more preferably as defined by any one of the SEQ ID NO:'s listed in Tables 1-3 (SEQ ID NOs. 1-375 and 3451-3603) or a variant thereof.

Accordingly, in preferred embodiments, the inventive mRNA comprises at least one coding region encoding at least one fragment of a protein or variant thereof derived from a lassa virus, preferably a glycoprotein precursor (GPC) derived from a lassa virus, said glycoprotein precursor (GPC) preferably comprising or consisting of an amino acid sequence of the sequences as defined by any one of SEQ ID NOs: 1-186, wherein said fragment preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97% to any one of the sequences as defined by SEQ ID NOs: 1-186 (or Table 1 column "A").

In preferred embodiments, the inventive mRNA comprises at least one coding region encoding at least one fragment of a protein or variant thereof derived from a lassa virus, preferably a variant nucleoprotein (NP) derived from a lassa virus, said nucleoprotein (NP) preferably comprising or consisting of an amino acid sequence of the sequences as defined by any one of SEQ ID NO: 187-375, wherein said fragment preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97% to any one of the sequences as defined by SEQ ID NOs: 187-375 (or Table 2 column "A").

In preferred embodiments, the inventive mRNA comprises at least one coding region encoding at least one fragment of a protein or variant thereof derived from a lassa virus, preferably a variant zinc-binding matrix protein (Z) derived from a lassa virus, said zinc-binding matrix protein (Z) preferably comprising or consisting of an amino acid sequence of the sequences as defined by any one of SEQ ID NO: 3451-3603, wherein said fragment preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97% to any one of the sequences as defined by SEQ ID NOs: 3451-3603 (or Table 3 column "A").

Accordingly, in preferred embodiments, the inventive mRNA comprises at least one coding region encoding a fragment of a glycoprotein precursor (GPC) derived from a lassa virus, said mRNA (in particular its coding region) comprising or consisting of an RNA sequence as defined by SEQ ID NOs: 376-561 or a fragment thereof, wherein said RNA sequence fragment has a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 376-561 (or Table 1 column "B").

In preferred embodiments, the inventive mRNA comprises at least one coding region encoding a variant nucleoprotein (NP) derived from a lassa virus, said mRNA (in particular its coding region) comprising or consisting of an RNA sequence as defined by SEQ ID NOs: 562-750 or a fragment thereof, wherein said RNA sequence fragment has a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 562-750 (or Table 2 column "B").

In preferred embodiments, the inventive mRNA comprises at least one coding region encoding a variant zinc-binding matrix protein (Z) derived from a lassa virus, said mRNA (in particular its coding region) comprising or consisting of an RNA sequence as defined by SEQ ID NOs: 3604-3756 or a fragment thereof, wherein said RNA sequence fragment has a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 3604-3756 (or Table 3 column "B").

In accordance with the above, in preferred embodiments, the inventive mRNA comprises at least one coding region encoding at least one antigenic peptide or protein derived from glycoprotein precursor (GPC) of a lassa virus according to SEQ ID NOs: 1-186 or a variant or fragment thereof. The coding region of said mRNA preferably comprises an RNA sequence selected from RNA sequences having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 376-561. Specifically, said coding region may comprise an RNA sequence selected from RNA sequences as defined by SEQ ID NOs: 751-936, 1126-1311, 1501-1686, 1876-2061, 2251-2436, 2626-2811 or 3001-3186 (or Table 1 column "C").

In further preferred embodiments, the inventive mRNA comprises at least one coding region encoding at least one antigenic peptide or protein derived from nucleoprotein (NP) of a lassa virus according to SEQ ID NOs. 187-375 or a variant or fragment thereof. Said coding region preferably comprises an RNA sequence selected from RNA sequences has a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 562-750. Specifically, said coding region may comprise an RNA sequence selected from RNA sequences as defined by SEQ ID NOs: 937-1125, 1312-1500, 1687-1875, 2062-2250, 2437-2625, 2812-3000 or 3187-3375 (or Table 2 column "C").

In further preferred embodiments, the inventive mRNA comprises at least one coding region encoding at least one antigenic peptide or protein derived from zinc-binding matrix protein (Z) of a lassa virus according to SEQ ID NOs. 3451-3603 or a variant or fragment thereof. Said coding region preferably comprises an RNA sequence selected from RNA sequences has a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an RNA sequence as defined by SEQ ID NOs: 3604-3756. Specifically, said coding region may comprise an RNA sequence selected from RNA sequences as defined by SEQ ID NOs: 3757-3909, 3910-4062, 4063-4215, 4216-4368, 4369-4521, 4522-4674, or 4675-4827 (or Table 3 column "C").

Mono-, Bi- and Multicistronic RNA

According to certain embodiments of the present invention, the mRNA is mono-, bi-, or multicistronic, preferably as defined herein. The coding sequences in a bi- or multicistronic mRNA preferably encode distinct antigenic peptides or proteins as defined herein (or variants or fragments of said peptides/proteins). Preferably, the coding sequences encoding two or more antigenic peptides or proteins may be separated in the bi- or multicistronic mRNA by at least one IRES sequence.

An "IRES" (internal ribosomal entry site) is an RNA element that allows for translation initiation in a cap-independent manner.

Thus, the term "encoding two or more peptides or proteins" may mean, without being limited thereto, that the bi- or even multicistronic mRNA, may encode e.g. at least two, three, four, five, six or more (preferably different) antigenic peptides or proteins or their variants or fragments within the definitions provided herein. More preferably, without being limited thereto, the bi- or even multicistronic mRNA, may encode, for example, at least two, three, four, five, six or more (preferably different) antigenic peptides or proteins as defined herein or their variants or fragments as defined herein.

In this context, a so-called IRES (internal ribosomal entry site) sequence as defined above can function as a sole ribosome binding site, but it can also serve to provide a bi- or even multicistronic mRNA as defined above, which encodes several antigenic peptides or proteins which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SN) or cricket paralysis viruses (CrPV).

According to further embodiments, the at least one coding region of the mRNA according to the invention may encode at least two, three, four, five, six, seven, eight and more antigenic peptides or proteins (or variants or fragments thereof) as defined herein linked with or without an amino acid linker sequence, wherein said linker sequence may comprise rigid linkers, flexible linkers, cleavable linkers (e.g., self-cleaving peptides) or a combination thereof. Therein, the antigenic peptides or proteins may be identical or different or a combination thereof.

In some embodiments, the at least one coding region of the mRNA according to the invention comprises at least two, three, four, five, six, seven, eight or more nucleic acid sequences identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the nucleic acid sequences disclosed in Tables 1-3 herein, or a variant or fragment of any one of said nucleic acid sequences.

Preferably, the mRNA comprising at least one coding region as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

Circular RNA:

In embodiments, the nucleic acid is an RNA, in particular a circular RNA. As used herein, "circular RNA" has to be understood as a circular polynucleotide that can encode at least one antigenic peptide or protein as defined herein. Accordingly, in preferred embodiments, said circular RNA comprises at least one coding sequence encoding at least one antigenic peptide or protein derived from a Lassa virus or a fragment or variant thereof as defined herein.

The production of circRNAs can be performed using various methods provided in the art. For example, U.S. Pat. No. 6,210,931 teaches a method of synthesizing circRNAs by inserting DNA fragments into a plasmid containing sequences having the capability of spontaneous cleavage and self-circularization. U.S. Pat. No. 5,773,244 teaches producing circRNAs by making a DNA construct encoding an RNA cyclase ribozyme, expressing the DNA construct as an RNA, and then allowing the RNA to self-splice, which produces a circRNA free from intron in vitro. WO1992/001813 teaches a process of making single strand circular nucleic acids by synthesizing a linear polynucleotide, combining the linear nucleotide with a complementary linking oligonucleotide under hybridization conditions, and ligating the linear polynucleotide. The person skilled in the art may also use methods provided in WO2015/034925 or WO2016/011222 to produce circular RNA. Accordingly, methods for producing circular RNA as provided in U.S. Pat. Nos. 6,210,931, 5,773,244, WO1992/001813, WO2015/034925 and WO2016/011222 are incorporated herewith by reference.

RNA In Vitro Transcription and RNA Purification:

In a preferred embodiment, the artificial nucleic acid is an RNA, preferably an mRNA.

The artificial RNA according to the present invention may be prepared using any method known in the art, including chemical synthesis such as e.g. solid phase RNA synthesis, as well as in vitro methods, such as RNA in vitro transcription reactions.

In a preferred embodiment, the artificial nucleic acid as defined herein, preferably the RNA as defined herein, is obtained by RNA in vitro transcription. Accordingly, the RNA of the invention is preferably an in vitro transcribed RNA.

The terms "RNA in vitro transcription" or "in vitro transcription" relate to a process wherein RNA is synthesized in a cell-free system (in vitro) as defined above. DNA, particularly plasmid DNA (or PCR product), is typically used as template for the generation of RNA transcripts.

In embodiments, the nucleotide mixture used in RNA in vitro transcription may additionally contain modified nucleotides as defined herein. In embodiments, the nucleotide mixture (i.e. the fraction of each nucleotide in the mixture) may be optimized for the given RNA sequence, preferably as described WO2015/188933.

In embodiment where more than one different artificial nucleic acid as defined herein has to be produced, e.g. where 2, 3, 4, 5, 6, 7, 8, 9, 10 or even more different artificial nucleic acids have to be produced (e.g. encoding different antigenic peptides, proteins of Lassa virus), procedures as described in WO2017/109134 may be suitably used.

In the context of nucleic acid vaccine production, it may be required to provide GMP-grade RNA. GMP-grade RNA may be suitably produced using a manufacturing process approved by regulatory authorities. Accordingly, in a particularly preferred embodiment, RNA production is performed under current good manufacturing practice (GMP), implementing various quality control steps on DNA and RNA level, according to WO2016/180430. Accordingly, the RNA of the invention is a GMP-grade RNA, particularly a GMP-grade mRNA.

The obtained RNA products are preferably purified using PureMessenger® (CureVac, Tubingen, Germany; RP-HPLC according to WO2008/077592) and/or tangential flow filtration (as described in WO2016/193206).

In a preferred embodiment, the RNA, particularly the purified RNA, is lyophilized according to WO2016/165831 or WO2011/069586 to yield a temperature stable dried artificial nucleic acid (powder) as defined herein. The RNA of the invention, particularly the purified RNA may also be dried using spray-drying or spray-freeze drying according to WO2016/184575 or WO2016184576 to yield a temperature stable artificial nucleic acid (powder) as defined herein. Accordingly, in the context of manufacturing and purifying nucleic acids, particularly RNA, the disclosures of WO2017/109161, WO2015/188933, WO2016/180430, WO2008/077592, WO2016/193206, WO2016/165831, WO2011/069586, WO2016/184575, and WO2016/184576 are incorporated herewith by reference.

Accordingly, in preferred embodiments the RNA is a dried RNA, particularly a dried mRNA.

The term "dried RNA" as used herein has to be understood as RNA that has been lyophilized, or spray-dried, or spray-freeze dried as defined above to obtain a temperature stable dried RNA (powder).

Accordingly, in preferred embodiments the RNA is a purified RNA, particularly purified mRNA.

The term "purified RNA" as used herein has to be understood as RNA which has a higher purity after certain purification steps (e.g. HPLC, TFF, precipitation steps) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases, BSA, pyrophosphatase, restriction endonuclease, DNase), spermidine, abortive RNA sequences, RNA fragments, free nucleotides (modified nucleotides, conventional NTPs, cap analogue), plasmid DNA fragments, buffer components (HEPES, TRIS, MgCl2) etc. Other impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full length RNA transcripts is as close as possible to 100%. Accordingly "purified RNA" as used herein has a degree of purity of more than 70%, 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

It has to be understood that "dried RNA" as defined herein and "purified RNA" as defined herein or "GMP-grade mRNA" as defined herein may have superior stability characteristics and improved efficiency (e.g. better translatability of the mRNA in vivo).

RNA Modifications

According to preferred embodiments, the inventive mRNA is an artificial mRNA. According to further preferred embodiments, the inventive mRNA is a modified mRNA. Suitable modifications envisaged in the context of the present invention are described below.

In this context, a modification as defined herein preferably leads to a stabilization of said mRNA. More preferably, the invention thus provides a stabilized mRNA According to a preferred embodiment, the inventive mRNA is thus be provided as a "stabilized" mRNA, i.e. which is essentially resistant to in vivo degradation (e.g. by an exo- or endonuclease).

Preferably, a stabilized mRNA in the context of the present invention is stabilized in a cell, such as a prokaryotic or eukaryotic cell, preferably in a mammalian cell, such as a human cell. Stabilization may also occur outside of cells, e.g. in a buffer solution etc., for example, in a manufacturing process for a pharmaceutical composition comprising the stabilized mRNA.

Such stabilization can be effected, for example, by a modified phosphate backbone of the inventive mRNA. A backbone modification in connection with the present invention is a modification, wherein phosphates of the backbone of the nucleotides contained in said mRNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized mRNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the mRNA according to the invention.

Chemical Modifications

The term "modification" as used herein may refer to chemical modifications comprising backbone modifications as well as sugar modifications or base modifications.

In this context, a "modified" mRNA may contain nucleotide analogues/modifications, e.g. backbone modifications, sugar modifications or base modifications. A backbone modification in connection with the present invention is a modification, in which phosphates of the backbone of the nucleotides contained in said mRNA herein are chemically modified. A sugar modification in connection with the present invention is a chemical modification of the sugar of the nucleotides of the mRNA. Furthermore, a base modification in connection with the present invention is a chemical modification of the base moiety of the nucleotides of the mRNA. In this context, nucleotide analogues or modifications are preferably selected from nucleotide analogues, which are applicable for transcription and/or translation.

Sugar Modifications:

The modified nucleosides and nucleotides, which may be incorporated into a "modified" mRNA as defined herein, can be modified in the sugar moiety.

For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)$_n$CH$_2$CH$_2$OR; "locked" nucleic acids (LNA) in which the 2' hydroxyl is connected, e.g., by a methylene bridge, to the 4' carbon of the same ribose sugar; and amino groups (—O—amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and 0.

The sugar group can also contain one or more carbons that possess the opposite stereochemical configuration than that of the corresponding carbon in ribose. Thus, a modified mRNA can include nucleotides containing, for instance, arabinose as the sugar.

Backbone Modifications:

The phosphate backbone may further be modified in the modified nucleosides and nucleotides, which may be incorporated into a "modified" mRNA as defined herein.

The phosphate groups of the backbone can be modified by replacing one or more of the oxygen atoms with a different substituent. Further, the modified nucleosides and nucleotides can include the full replacement of an unmodified phosphate moiety with a modified phosphate as described herein.

Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a "modified" mRNA as defined herein can further be modified in the nucleobase moiety.

Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In some embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'—O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, 06-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyluridine, 1-carboxymethyl-pseudouridine, 5-propynyluridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine. In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'—O-(1-thiophosphate)-adenosine, 5'—O-(1-thiophosphate)-cytidine, 5'—O-(1-thiophosphate)-guanosine, 5'—O-(1-thiophosphate)-uridine or 5'—O-(1-thiophosphate)-pseudouridine.

In some embodiments, a "modified" mRNA comprises nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

In some embodiments, a "modified" mRNA does not comprise any of the chemical modifications as described herein. Said modified mRNA may comprise a lipid modification or a sequence modification as described below.

Lipid Modifications

According to further embodiments, a "modified" mRNA as defined herein contains at least one lipid modification.

Such a lipid-modified mRNA may comprise (i) an mRNA as defined herein, (ii) at least one linker covalently linked with said mRNA, and (iii) at least one lipid covalently linked with the respective linker.

Alternatively, the lipid-modified mRNA may comprise at least one mRNA as defined herein, and at least one (bifunctional) lipid covalently linked (without a linker) with said mRNA.

Alternatively, the lipid-modified mRNA may comprise (i) an mRNA as defined herein, (ii) at least one linker covalently linked with said mRNA, and (iii) at least one lipid covalently linked with the respective linker, and (iv) at least one (bifunctional) lipid covalently linked (without a linker) with said mRNA.

In this context, it is particularly preferred that the lipid modification is present at the terminal ends of a linear mRNA.

Sequence Modifications

According to preferred embodiments, the inventive mRNA comprises at least one sequence modification as described below.

G/C Content Modification:

According to preferred embodiments, the mRNA may be modified, and thus stabilized, by modifying the guanosine/cytosine (G/C) content of said mRNA, preferably of the at least one coding sequence of said mRNA. In other words, the inventive mRNA may be G/C modified.

A "G/C-modified" mRNA typically comprises an RNA sequence that is based on a modified wild type RNA sequence and comprises an altered number of guanosine and/or cytosine nucleotides as compared to said wild type RNA sequence. Such an altered number of G/C nucleotides may be generated by substituting codons containing adenosine or thymidine nucleotides by "synonymous" codons containing guanosine or cytosine nucleotides. Accordingly, the codon substitutions preferably do not alter the encoded amino acid residues, but exclusively alter the G/C content of the nucleic acid molecule.

In a particularly preferred embodiment of the present invention, the G/C content of the coding sequence of the mRNA is modified, particularly increased, compared to the G/C content of the coding sequence of the respective wild type (i.e. unmodified) mRNA. The amino acid sequence encoded by the inventive mRNA is preferably not modified as compared to the amino acid sequence encoded by the respective wild type mRNA.

Such modifications of the mRNA are based on the fact that the sequence of any mRNA region to be translated is important for efficient translation of said mRNA. Thus, the composition of the mRNA and the sequence of various nucleotides are important. In particular, sequences having an increased G (guanosine)/C (cytosine) content are more stable than sequences having an increased A (adenosine)/U (uracil) content.

According to the invention, the codons of the inventive mRNA may therefore be varied compared to the respective wild type mRNA, while retaining the translated amino acid sequence, such that they include an increased amount of G/C nucleotides.

In respect to the fact that several codons code for one and the same amino acid (so-called degeneration of the genetic code), the most favourable codons for the stability can be determined (so-called alternative codon usage). Depending on the amino acid to be encoded by the inventive mRNA, there are various possibilities for modification of the mRNA sequence, compared to its wild type sequence. In the case of amino acids, which are encoded by codons, which contain exclusively G or C nucleotides, no modification of the codon is necessary.

Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U.

Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides.

Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUC; the codons for Thr can be modified from ACU or ACA to ACC or ACG; the codon for Asn can be modified from AAU to AAC; the codon for Lys can be modified from AAA to AAG; the codons for Val can be modified from GUU or GUA to GUC or GUG; the codon for Asp can be modified from GAU to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the inventive mRNA compared to its particular wild type mRNA sequence (i.e. the original sequence). Thus, for example, all codons for Thr occurring in the wild type sequence can be modified to ACC (or ACG). Preferably, however, for example, combinations of the above substitution possibilities are used:

substitution of all codons coding for Thr in the original sequence (wild type RNA) to ACC (or ACG) and substitution of all codons originally coding for Ser to UCC (or UCG or AGC); substitution of all codons coding for Ile in the original sequence to AUC and substitution of all codons originally coding for Lys to AAG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Gly to GGC (or GGG) and substitution of all codons originally coding for Asn to AAC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc.

Preferably, the G/C content of the coding sequence of the inventive mRNA is increased by at least 7%, more preferably by at least 15%, particularly preferably by at least 20%, compared to the G/C content of the coding sequence of the wild type mRNA, which codes for an antigenic peptide or protein as defined herein or a variant or fragment thereof.

According to preferred embodiments, at least 5%, 10%, 20%, 30%, 40%, 50%, 60%, more preferably at least 70%, even more preferably at least 80% and most preferably at least 90%, 95% or even 100% of the substitutable codons in the coding region (encoding an antigenic protein or peptide as defined herein) or the whole sequence of the wild type mRNA sequence are substituted, thereby increasing the G/C content of said mRNA sequence.

In this context, it is particularly preferable to increase the G/C content of the inventive mRNA, preferably of its at least one coding sequence, to the maximum (i.e. 100% of the substitutable codons) as compared to the wild type sequence.

A further preferred modification of the mRNA is based on the finding that the translation efficiency is also determined by a different frequency in the occurrence of tRNAs in cells.

Thus, in case an mRNA comprises an increased number of so-called "rare codons", the corresponding mRNA is translated to a significantly poorer degree than mRNAs comprising codons coding for relatively "frequent" tRNAs.

In some preferred embodiments, in modified mRNAs of the invention, the coding region encoding an antigenic peptide or protein is modified compared to the corresponding region of the wild type mRNA such that at least one codon of the wild type sequence, which codes for a tRNA which is relatively rare in the cell, is exchanged for a codon, which codes for a tRNA which is relatively frequent in the cell and carries the same amino acid as the relatively rare tRNA.

Thereby, the sequence of the mRNA is modified by inserting that codons which code for frequently occurring tRNAs. In other words, according to the invention, by this modification all codons of the wild type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons, which use for the particular amino acid the tRNA which occurs the most frequently, e.g. the Gly codon, which uses the tRNA, which occurs the most frequently in the (human) cell, are particularly preferred.

According to the invention, it is particularly preferable to link the sequential G/C content which is increased, in particular maximized, in the modified mRNA, with the "frequent" codons without modifying the encoded amino acid sequence, e.g. of antigenic protein or peptide encoded by the coding sequence of said mRNA. Such preferred embodiments are envisaged to allow the provision of a particularly efficiently translated and stabilized (modified) mRNA.

The determination of a modified mRNA as described above (increased G/C content; exchange of tRNAs) can be carried out using the computer program explained in WO02/098443, the disclosure content of which is included in its full scope in the present invention. Using this computer program, the nucleotide sequence of any desired nucleic acid, in particular mRNA, can be modified with the aid of the genetic code or the degenerative nature thereof such that a maximum G/C content results, in combination with the use of codons which code for tRNAs occurring as frequently as possible in the cell, the amino acid sequence coded by the modified nucleic acid, in particular mRNA, preferably not being modified compared to the non-modified sequence.

Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO02/098443.

In further preferred embodiments of the present invention, the A/U content in the environment of the ribosome binding site of the mRNA is increased compared to the A/U content in the environment of the ribosome binding site of its respective wild type mRNA.

This modification (an increased A/U content around the ribosome binding site) increases the efficiency of ribosome binding to said mRNA. An effective binding of the ribosomes to the ribosome binding site (Kozak sequence: SEQ ID NO: 3397; the AUG forms the start codon) in turn has the effect of an efficient translation of the inventive mRNA.

According to further embodiments of the present invention, the mRNA may be modified with respect to potentially destabilizing sequence elements. Particularly, the coding sequence and/or the 5' and/or 3' untranslated region of said mRNA may be modified compared to the respective wild type mRNA such that it contains no destabilizing sequence elements, the encoded amino acid sequence of the modified mRNA preferably not being modified compared to its respective wild type mRNA.

It is known that, for example in sequences of eukaryotic RNAs, destabilizing sequence elements (DSE) occur, to which signal proteins bind and regulate enzymatic degradation of RNA in vivo. For further stabilization of the modified mRNA, optionally in coding region encoding the antigenic peptide or protein as defined herein, one or more such modifications compared to the corresponding region of the wild type mRNA can therefore be carried out, so that no or substantially no destabilizing sequence elements are contained there.

According to the invention, DSE present in the untranslated regions (3'- and/or 5'-UTR) can also be eliminated from the inventive mRNA by such modifications. Such destabilizing sequences are e.g. AU-rich sequences (AU-RES), which occur in 3'-UTR sections of numerous unstable RNAs (Caput et al., Proc. Natl. Acad. Sci. USA 1986, 83: 1670 to 1674). The inventive mRNA is therefore preferably modified compared to the respective wild type RNA such that said mRNA contains no such destabilizing sequences. This also applies to those sequence motifs which are recognized by possible endonucleases, e.g. the sequence GAACAAG, which is contained in the 3'-UTR segment of the gene encoding the transferrin receptor (Binder et al., EMBO J. 1994, 13: 1969 to 1980). These sequence motifs are also preferably removed from the inventive mRNA.

Accordingly, in preferred embodiments, inventive mRNAs comprise at least one coding region encoding a glycoprotein precursor (GPC) derived from a lassa virus, wherein said coding region comprises or consists of a G/C optimized RNA sequence as defined by SEQ ID NOs: 751-936, 2251-2436, 2626-2811 or 3001-3186, or a variant or fragment of thee sequences.

Accordingly, in preferred embodiments, inventive mRNAs comprise at least one coding region encoding a nucleoprotein (NP) derived from a lassa virus, wherein said coding region comprises or consists of a G/C optimized RNA sequence as defined by SEQ ID NOs: 937-1125, 2437-2625, 2812-3000 or 3187-3375 or a variant or fragment of thee sequences.

Accordingly, in preferred embodiments, inventive mRNAs comprise at least one coding region encoding a zinc-binding matrix protein (Z) derived from a lassa virus, wherein said coding region comprises or consists of a G/C optimized RNA sequence as defined by SEQ ID NOs: 3757-3909, 4369-4521, 4522-4674 or 4675-4827 or a variant or fragment of thee sequences.

Sequences Adapted to Human Codon Usage:

A further preferred modification of the inventive mRNA is based on the finding that codons encoding the same amino acid typically occur at different frequencies. According to further preferred embodiments, in the modified mRNA, the coding sequence is modified compared to the corresponding region of the respective wild type RNA (or said other wild type nucleic acid) such that the frequency of the codons encoding the same amino acid corresponds to the naturally occurring frequency of that codon according to the human codon usage as e.g. shown in Table 4.

For example, in the case of the amino acid alanine (Ala) present in an amino acid sequence encoded by the at least one coding sequence of the mRNA, the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 4).

TABLE 4

Human codon usage table

| Amino acid | codon | fraction | /1000 | Amino acid | codon | fraction | /1000 |
|---|---|---|---|---|---|---|---|
| Ala | GCG | 0.10 | 7.4 | Pro | CCG | 0.11 | 6.9 |
| Ala | GCA | 0.22 | 15.8 | Pro | CCA | 0.27 | 16.9 |
| Ala | GCT | 0.28 | 18.5 | Pro | CCT | 0.29 | 17.5 |
| Ala | GCC* | 0.40 | 27.7 | Pro | CCC* | 0.33 | 19.8 |
| Cys | TGT | 0.42 | 10.6 | Gln | CAG* | 0.73 | 34.2 |
| Cys | TGC* | 0.58 | 12.6 | Gln | CAA | 0.27 | 12.3 |
| Asp | GAT | 0.44 | 21.8 | Arg | AGG | 0.22 | 12.0 |
| Asp | GAC* | 0.56 | 25.1 | Arg | AGA* | 0.21 | 12.1 |
| Glu | GAG* | 0.59 | 39.6 | Arg | CGG | 0.19 | 11.4 |
| Glu | GAA | 0.41 | 29.0 | Arg | CGA | 0.10 | 6.2 |
| Phe | TTT | 0.43 | 17.6 | Arg | CGT | 0.09 | 4.5 |
| Phe | TTC* | 0.57 | 20.3 | Arg | CGC | 0.19 | 10.4 |
| Gly | GGG | 0.23 | 16.5 | Ser | AGT | 0.14 | 12.1 |
| Gly | GGA | 0.26 | 16.5 | Ser | AGC* | 0.25 | 19.5 |
| Gly | GGT | 0.18 | 10.8 | Ser | TCG | 0.06 | 4.4 |
| Gly | GGC* | 0.33 | 22.2 | Ser | TCA | 0.15 | 12.2 |
| His | CAT | 0.41 | 10.9 | Ser | TCT | 0.18 | 15.2 |
| His | CAC* | 0.59 | 15.1 | Ser | TCC | 0.23 | 17.7 |
| Ile | ATA | 0.14 | 7.5 | Thr | ACG | 0.12 | 6.1 |
| Ile | ATT | 0.35 | 16.0 | Thr | ACA | 0.27 | 15.1 |
| Ile | ATC* | 0.52 | 20.8 | Thr | ACT | 0.23 | 13.1 |
| Lys | AAG* | 0.60 | 31.9 | Thr | ACC* | 0.38 | 18.9 |
| Lys | AAA | 0.40 | 24.4 | Val | GTG* | 0.48 | 28.1 |
| Leu | TTG | 0.12 | 12.9 | Val | GTA | 0.10 | 7.1 |
| Leu | TTA | 0.06 | 7.7 | Val | GTT | 0.17 | 11.0 |
| Leu | CTG* | 0.43 | 39.6 | Val | GTC | 0.25 | 14.5 |
| Leu | CTA | 0.07 | 7.2 | Trp | TGG* | 1 | 13.2 |
| Leu | CTT | 0.12 | 13.2 | Tyr | TAT | 0.42 | 12.2 |
| Leu | CTC | 0.20 | 19.6 | Tyr | TAC* | 0.58 | 15.3 |
| Met | ATG* | 1 | 22.0 | Stop | TGA* | 0.61 | 1.6 |
| Asn | AAT | 0.44 | 17.0 | Stop | TAG | 0.17 | 0.8 |
| Asn | AAC* | 0.56 | 19.1 | Stop | TAA | 0.22 | 1.0 |

*most frequent codon

Accordingly, in preferred embodiments, inventive mRNAs comprise at least one coding region encoding a glycoprotein precursor (GPC) derived from a lassa virus, wherein said coding region comprises or consists of an RNA sequence adapted to human codon usage as defined by SEQ ID NOs: 1501-1686 or a variant or fragment of these sequences.

Accordingly, in preferred embodiments, inventive mRNAs comprise at least one coding region encoding a nucleoprotein (NP) derived from a lassa virus, wherein said coding region comprises or consists of an RNA sequence adapted to human codon usage as defined by SEQ ID NOs: 1687-1875 or a variant or fragment of these sequences.

Accordingly, in preferred embodiments, inventive mRNAs comprise at least one coding region encoding a zinc-binding matrix protein (Z) derived from a lassa virus, wherein said coding region comprises or consists of an RNA sequence adapted to human codon usage as defined by SEQ ID NOs: 4063-4215 or a variant or fragment of these sequences.

Codon-Optimized Sequences:

As described above it is preferred according to the invention, that all codons of the wild type sequence which code for a tRNA, which is relatively rare in the cell, are exchanged for a codon which codes for a tRNA, which is relatively frequent in the cell and which, in each case, carries the same amino acid as the relatively rare tRNA.

Therefore, it is particularly preferred that the most frequent codons are used for each encoded amino acid (see Table 4, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences.

According to preferred embodiments, the inventive mRNA comprises at least one coding sequence, wherein the coding sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the mRNA, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

Accordingly, in preferred embodiments, inventive mRNAs comprise at least one coding region encoding a glycoprotein precursor (GPC) derived from a lassa virus, wherein said coding region comprises or consists of a codon optimized RNA sequence as defined by SEQ ID NOs: 1876-2061 or a variant or fragment of these sequences.

Accordingly, in preferred embodiments, inventive mRNAs comprise at least one coding region encoding a nucleoprotein (NP) derived from a lassa virus, wherein said coding region comprises or consists of codon optimized RNA sequence as defined by SEQ ID NOs: 2062-2250 or a variant or fragment of these sequences.

Accordingly, in preferred embodiments, inventive mRNAs comprise at least one coding region encoding a zinc-binding matrix protein (Z) derived from a lassa virus, wherein said coding region comprises or consists of codon optimized RNA sequence as defined by SEQ ID NOs: 4216-4368 or a variant or fragment of these sequences.

C-Optimized Sequences:

According to preferred embodiments, the inventive mRNA is modified by modifying, preferably increasing, the cytosine (C) content of said mRNA, in particular in its at least one coding sequence.

In preferred embodiments, the C content of the coding sequence of the inventive mRNA is modified, preferably increased, compared to the C content of the coding sequence of the respective wild type (unmodified) RNA. The amino acid sequence encoded by the at least one coding sequence of the inventive mRNA is preferably not modified as compared to the amino acid sequence encoded by the respective wild type mRNA.

In preferred embodiments, said modified mRNA according to the invention is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the wild type mRNA sequence, which are "cytosine content optimizable" are replaced by codons having a higher cytosine-content than the ones present in the wild type sequence.

In further preferred embodiments, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In further preferred embodiments of the present invention, the modified mRNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term "cytosine content-optimizable codon" as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding sequence increases its overall C-content and reflects a C-enriched modified RNA sequence.

According to some preferred embodiments, the inventive mRNA, and in particular its at least one coding sequence, comprises or consists of a C-maximized sequence containing C-optimized codons for all potentially C-optimizable codons. Accordingly, 100% or all of the theoretically replaceable C-optimizable codons are preferably replaced by C-optimized codons over the entire length of the coding sequence.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or the codon UGU that codes for Cys may be exchanged by the codon UGC encoding the same amino acid, and/or the codon GAU which codes for Asp may be exchanged by the codon GAC encoding the same amino acid, and/or the codon that UUU that codes for Phe may be exchanged for the codon UUC encoding the same amino acid, and/or any of the codons GGG, GGA, GGU that code Gly may be exchanged by the codon GGC encoding the same amino acid, and/or the codon CAU that codes for His may be exchanged by the codon CAC encoding the same amino acid, and/or any of the codons AUA, AUU that code for Ile may be exchanged by the codon AUC, and/or any of the codons UUG, UUA, CUG, CUA, CUU coding for Leu may be exchanged by the codon CUC encoding the same amino acid, and/or the codon AAU that codes for Asn may be exchanged by the codon AAC encoding the same amino acid, and/or any of the codons CCG, CCA, CCU coding for Pro may be exchanged by the codon CCC encoding the same amino acid, and/or any of the codons AGG, AGA, CGG, CGA, CGU coding for Arg may be exchanged by the codon CGC encoding the same amino acid, and/or any of the codons AGU, AGC, UCG, UCA, UCU coding for Ser may be exchanged by the codon UCC encoding the same amino acid, and/or any of the codons ACG, ACA, ACU coding for Thr may be exchanged by the codon ACC encoding the same amino acid, and/or any of the codons GUG, GUA, GUU coding for Val may be exchanged by the codon GUC encoding the same amino acid, and/or the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding sequence results in a C-maximized coding sequence. In the context of the invention, at least 70%, preferably at least 80%, more preferably at least 90%, of the non C-optimized codons within the at least one coding sequence of the inventive mRNA are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding sequence.

Preferably, in a C-optimized mRNA according to the invention, at least 50% of the C-optimizable wild type codons for any given amino acid are replaced by C-optimized codons, e.g. any modified C-enriched mRNA preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GAA coding for Glu may be exchanged by the relative frequent codon GAG coding for the same amino acid, and/or the relatively rare codon AAA coding for Lys may be exchanged by the relative frequent codon AAG coding for the same amino acid, and/or the relatively rare codon CAA coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (UGA).

The single substitutions listed above may be used individually as well as in all possible combinations in order to optimize the cytosine-content of the modified mRNA according to the invention compared to the respective wild type mRNA.

Accordingly, the coding sequence as defined herein may be changed compared to the coding sequence of the respective wild type RNA in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

Accordingly, in preferred embodiments, inventive mRNAs comprise at least one coding region encoding a glycoprotein precursor (GPC) derived from a lassa virus, wherein said coding region comprises or consists of a C-optimized RNA sequence as defined by SEQ ID NOs: 1126-1311 or a variant or fragment of these sequences.

Accordingly, in preferred embodiments, inventive mRNAs comprise at least one coding region encoding a nucleoprotein (NP) derived from a lassa virus, wherein said coding region comprises or consists of C-optimized RNA sequence as defined by SEQ ID NOs: 1312-1500 or a variant or fragment of these sequences.

Accordingly, in preferred embodiments, inventive mRNAs comprise at least one coding region encoding a zinc-binding matrix protein (Z) derived from a lassa virus, wherein said coding region comprises or consists of C-optimized RNA sequence as defined by SEQ ID NOs: 3910-4062 or a variant or fragment of these sequences.

According to particularly preferred embodiments, the (modified) mRNA according to the invention comprises at least one coding sequence as defined herein, wherein (a) the G/C content of the at least one coding sequence of said mRNA is increased compared to the G/C content of the corresponding coding sequence of the corresponding wild type mRNA, and/or (b) wherein the C content of the at least one coding sequence of said mRNA is increased compared to the C content of the corresponding coding sequence of the corresponding wild type mRNA, and/or (c) wherein the codons in the at least one coding sequence of said mRNA are adapted to human codon usage, wherein the codon adaptation index (CAI) is preferably increased or maximized in the at least one coding sequence of said mRNA, and wherein the amino acid sequence encoded by said mRNA is preferably not being modified compared to the amino acid sequence encoded by the corresponding wild type RNA.

5'-cap

According to further preferred embodiments, the inventive mRNA comprises a "5'-cap" structure, which preferably stabilizes said mRNA.

A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a modified mRNA in this context. Accordingly, a "modified" mRNA may comprise an m7GpppN as 5'-cap, but additionally the modified RNA typically comprises at least one further modification as defined herein.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

According to preferred embodiments, the inventive mRNA comprises a 5'-cap structure and/or at least one 3'-untranslated region element (3'-UTR element), preferably as defined herein. More preferably, said mRNA further comprises a 5'-UTR element as defined herein.

Poly(A)

According to further preferred embodiments, the inventive mRNA contains a poly-A tail. A poly(A) sequence, also called poly(A) tail or 3'-poly(A) tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. As used herein, a poly(A) sequence may also comprise about 10 to 200 adenosine nucleotides, preferably about 10 to 100 adenosine nucleotides, more preferably about 40 to 80 adenosine nucleotides or even more preferably about 50 to 70 adenosine nucleotides. A poly(A) sequence is typically located at the 3'-end of an mRNA.

Accordingly, in further preferred embodiments, the inventive mRNA comprises at its 3'-terminus a poly(A) tail of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the mRNA is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the mRNA using commercially available polyadenylation kits and corresponding protocols known in the art.

Polyadenylation is typically understood to be the addition of a poly(A) sequence to a nucleic acid molecule, such as an RNA molecule, e.g. to a premature mRNA. Polyadenylation may be induced by a so-called polyadenylation signal. This signal is preferably located within a stretch of nucleotides at the 3'-end of the mRNA to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises a step of polyadenylation.

Alternatively, the inventive mRNA optionally comprises a polyadenylation signal. Accordingly, the inventive mRNA may comprise a polyadenylation signal which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)).

In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(c)

According to further preferred embodiments, the inventive mRNA contains a poly(C) tail on the 3'-terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

UTRs

According to preferred embodiments, the inventive mRNA comprises at least one 5'- or 3'-UTR element. In this context, an UTR element comprises or consists of a nucleic acid sequence, which is derived from the 5'—or 3'-UTR of any naturally occurring gene or which is derived from a fragment, a homolog or a variant of the 5'- or 3'-UTR of a gene. Preferably, the 5'- or 3'-UTR element used according to the present invention is heterologous to the at least one coding sequence of the mRNA. Even if 5'- or 3'-UTR elements derived from naturally occurring genes are preferred, also synthetically engineered UTR elements may be used in the context of the present invention.

3'-U7R

According to preferred embodiments, the inventive mRNA further comprises at least one 3'-UTR element.

The term "3'-UTR element" typically refers to a nucleic acid sequence, which comprises or consists of a nucleic acid sequence that is derived from a 3'-UTR or from a variant of a 3'-UTR.

Generally, the term "3'-UTR" refers to a part of a nucleic acid molecule, which is located 3' (i.e. "downstream") of an open reading frame and which is not translated into protein. In the context of the present invention, a 3'-UTR corresponds to the sequence of a mature mRNA, which is located between the stop codon of the protein coding sequence, preferably immediately 3' to the stop codon of the protein coding sequence, and the poly(A) sequence of the mRNA. The term "corresponds to" means that the 3'-UTR sequence may be an RNA sequence, such as in the mRNA sequence used for defining the 3'-UTR sequence, or a DNA sequence, which corresponds to such RNA sequence. In the context of the present invention, the term "a 3'-UTR of a gene", such as "a 3'-UTR of a ribosomal protein gene", is the sequence, which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR.

A 3'-UTR element in the sense of the present invention may represent the 3'-UTR of an RNA, preferably an mRNA. Thus, in the sense of the present invention, preferably, a 3'-UTR element may be the 3'-UTR of an RNA, preferably of an mRNA, or it may be the transcription template for a 3'-UTR of an RNA. Thus, a 3'-UTR element preferably is a nucleic acid sequence which corresponds to the 3'-UTR of an RNA, preferably to the 3'-UTR of an mRNA, such as an mRNA obtained by transcription of a genetically engineered vector construct. Preferably, the 3'-UTR element fulfils the function of a 3'-UTR or encodes a sequence which fulfils the function of a 3'-UTR.

Preferably, the at least one 3'-UTR element of the inventive mRNA comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the inventive mRNA comprises a 3'-UTR element, which may be derivable from a gene that relates to an mRNA with an enhanced half-life (that provides a stable mRNA), for example a 3'-UTR element as defined and described below. Preferably, the 3'-UTR element comprises or consists of a nucleic acid sequence derived from a 3'-UTR of a gene, which preferably encodes a stable mRNA, or from a homolog, a fragment or a variant of said gene.

In particularly preferred embodiments, the 3'-UTR element comprises or consists of a nucleic acid sequence, which is derived from a 3'-UTR of a gene selected from the group consisting of an albumin gene, an alpha-globin gene, a beta-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an alpha-globin gene, a beta-globin gene, a tyrosine hydroxylase gene, a lipoxygenase gene, and a collagen alpha gene, such as a collagen alpha 1(I) gene according to SEQ ID NO: 1369-1390 of the patent application WO2013/143700, whose disclosure is incorporated herein by reference, or from a homolog, a fragment or a variant thereof.

The term "a nucleic acid sequence which is derived from the 3'-UTR of a [ . . . ] gene, preferably refers to a nucleic acid sequence which is based on the 3'-UTR sequence of a [ . . . ] gene or on a part thereof, such as on the 3'-UTR of an albumin gene, an alpha-globin gene, a beta-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, alpha-globin gene, beta-globin gene, tyrosine hydroxylase gene, lipoxygenase gene, or collagen alpha gene, such as a collagen alpha 1(I) gene, preferably of an albumin gene.

The term "a nucleic acid sequence which is derived from a variant of the 3'-UTR of a [ . . . ] gene, preferably refers to a nucleic acid sequence, which is based on a variant of the 3'-UTR sequence of a gene, such as on a variant of the 3'-UTR of an albumin gene, an alpha-globin gene, a beta-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A "fragment" in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

Albumin-Derived 3'-UTRs:

In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene according to SEQ ID NO: 3388 or the corresponding RNA sequence SEQ ID NO: 3389.

Human albumin 3'-UTR SEQ ID NO: 3388:

CATCACATTTAAAAGCATCTCAGCCTACCATGAGAATAAGAGAAAGAAAA

TGAAGATCAAAAGCTTATTCATCTGTTTTTCTTTTTCGTTGGTGTAAAG

CCAACACCCTGTCTAAAAAACATAAATTTCTTTAATCATTTTGCCTCT

TTTCTCTGTGCTTCAATTAATAAAAAATGGAAAGAATCT (corresponding to SEQ ID NO: 1369 of the patent application WO2013/143700).

In this context it is particularly preferred that the mRNA comprises a 3'-UTR element comprising a corresponding RNA sequence derived from the nucleic acids according to SEQ ID NO: 1369-1390 of the patent application WO2013/143700 or a fragment, homolog or variant thereof.

Most preferably the 3'-UTR element comprises the nucleic acid sequence derived from a fragment of the human albumin gene according to SEQ ID NO: 3390 or 3392:
albumin7 3'UTR:

CATCACATTTAAAAGCATCTCAGCCTACCATGAGAATAAGAGAAAGAAA

ATGAAGATCAATAGCTTATTCATCTCTTTTTCTTTTTCGTTGGTGTAAAG

CCAACACCCTGTCTAAAAAACATAAATTTCTTTAATCATTTTGCCTC

TTTTCTCTGTGCTTCAATTAATAAAAAATGGAAAGAACCT (SEQ ID

NO: 3390 corresponding to SEQ ID NO: 1376 of the patent application WO2013/143700)

In this context, it is particularly preferred that the 3'-UTR element of the inventive mRNA comprises or consists of a corresponding RNA sequence of the nucleic acid sequence according to SEQ ID NO: 3390 or 3392 as shown in SEQ ID NO: 3391 or 3393.

Globin-Derived 3'-UTRs

In another particularly preferred embodiment, the 3'-UTR element of the inventive mRNA comprises or consists of a nucleic acid sequence which is derived from a 3'-UTR of an alpha-globin gene, preferably a vertebrate alpha- or beta-globin gene, more preferably a mammalian alpha- or beta-globin gene, most preferably a human alpha- or beta-globin gene according to SEQ ID NO: 3380, 3382 or 3384 or the corresponding RNA sequences SEQ ID NO: 3381, 3383 or 3385: 3'-UTR of *Homo sapiens* hemoglobin, alpha 1 (HBA1):

GCCCGATGGGCCTCCCAACGGGCCCTCCTCCCCTCCTTGCACCG (SEQ

ID NO: 3386 corresponding to SEQ ID NO: 1393 of the patent application WO2013/143700).

3'-UTR of *Homo sapiens* Hemoglobin, Alpha 2 (HBA2)

GCTGGAGCCTCGGTAGCCGTTCCTCCTGCCCGCTGGGCCTCCCAAC

GGGCCCTCCTCCCCTCCTTGCACCGGCCCTTCCTGGTCTTTGAATA

AAGTCTGAGTGGGCAG (SEQ ID NO: 3382 corresponding to SEQ ID NO: 1371 of the patent application

WO2013/143700)

3'-UTR of *Homo sapiens* Hemoglobin, Beta (HBB)

GCTCGCTTTCTTGCTGTCCAATTTCTATTAAAGGTTCCTTTGTTCCCTAA

GTCCAACTACTAAACTGGGGGATATTATGAAGGGCCTTGAGCATCTGGAT

TCTGCCTAATAAAAAACATTTATTTTCATTGC (SEQ ID NO: 3384 corresponding to SEQ ID NO: 1372 of the patent application WO2013/143700)

For example, the 3'-UTR element may comprise or consist of the centre, alpha-complex-binding portion of the 3'-UTR of an alpha-globin gene, such as of a human alpha-globin gene, or a homolog, a fragment, or a variant of an alpha-globin gene, preferably according to SEQ ID NO: 3386:

Centre, alpha-complex-binding portion of the 3'-UTR of an alpha-globin gene (also named herein as "muag"):

GCCCGATGGGCCTCCCAACGGGCCCTCCTCCCCTCCTTGCACCG
(SEQ ID NO: 3386 corresponding to SEQ ID NO: 1393
of the patent application WO2013/143700).

In this context it is particularly preferred that the 3'-UTR element of the inventive mRNA comprises or consists of a corresponding RNA sequence of the nucleic acid sequence according to SEQ ID NO: 3386 as shown in SEQ ID NO: 3387, or a homolog, a variant or fragment thereof.

5'-UTR

In preferred embodiments, the inventive mRNA further comprises a 5'-UTR.

A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites. The 5'-UTR may be post-transcriptionally modified, for example by addition of a 5'-cap. In the context of the present invention, a 5'-UTR corresponds to the sequence of a mature mRNA, which is located between the 5'-cap and the start codon. Preferably, the 5'-UTR corresponds to the sequence, which extends from a nucleotide located 3' to the 5'-cap, preferably from the nucleotide located immediately 3' to the 5'-cap, to a nucleotide located 5' to the start codon of the protein coding sequence, preferably to the nucleotide located immediately 5' to the start codon of the protein coding sequence. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence, which corresponds to such RNA sequence. In the context of the present invention, the term "a 5'-UTR of a gene" is the sequence, which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR. By the inventive embodiments such a 5'-UTR may be provided 5'-terminal to the coding sequence. Its length is typically less than 500, 400, 300, 250 or less than 200 nucleotides. In other embodiments its length may be in the range of at least 10, 20, 30 or 40, preferably up to 100 or 150, nucleotides.

According to particularly preferred embodiments, the inventive mRNA comprises at least one 5'-untranslated region element (5'-UTR element) which comprises or consists of a nucleic acid sequence, which is derived from the 5'-UTR of a TOP gene or which is derived from a fragment, homolog or variant of the 5'-UTR of a TOP gene.

The 5'terminal oligopyrimidine tract (TOP) is typically a stretch of pyrimidine nucleotides located in the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. An mRNA that contains a 5'terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP genes are typically characterized by the presence of a 5' terminal oligopyrimidine tract (TOP). Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-cap to the nucleotide located 5' to the start codon. A 5'-UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID Nos. 1-1363 of the patent application WO2013/143700, whose disclosure is incorporated herewith by reference. In this context, a particularly preferred fragment of a 5'-UTR of a TOP gene is a 5'-UTR of a TOP gene lacking the 5'TOP motif. The terms "5'-UTR of a TOP gene" or "5'-TOP UTR" preferably refer to the 5'-UTR of a naturally occurring TOP gene.

In the context of the present invention, a "TOP motif" is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TOP genes and TOP mRNAs, the TOP-motif preferably starts at its 5'-end with the transcriptional start site and ends one nucleotide 5' to the first purin residue in said gene or mRNA. A TOP motif in the sense of the present invention is preferably located at the 5'-end of a sequence, which represents a 5'-UTR, or at the 5'-end of a sequence, which codes for a 5'-UTR. Thus, preferably, a stretch of 3 or more pyrimidine nucleotides is called 'TOP motif' in the sense of the present invention if this stretch is located at the 5'-end of a respective sequence, such as the artificial nucleic acid molecule, the 5'-UTR element of the artificial nucleic acid molecule, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif".

In particularly preferred embodiments, the 5'-UTR element of the inventive mRNA does not comprise a TOP-motif or a 5'TOP, as defined above.

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding sequence. Thus, preferably, the only amino acid coding part of the inventive mRNA is provided by the coding sequence.

The nucleic acid sequence derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID Nos. 1-1363, SEQ ID NO: 1395, SEQ ID NO: 1421 and SEQ ID NO: 1422 of the patent application WO2013/143700, whose disclosure is incorporated herein by reference, from the homologs of SEQ ID Nos. 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than homo Sapiens, which are homologous to the sequences according to SEQ ID NOs: 1-1363, SEQ ID NO: 1395, SEQ ID NO: 1421 and SEQ ID NO: 1422 of the patent application WO2013/143700.

In preferred embodiments, the 5'-UTR element of the inventive mRNA comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5'-UTR element is derived from a nucleic acid sequence extending from the nucleotide position immediately 3' to the 5'TOP to the nucleotide position immediately 5' to the start codon (located at the 3'-end of the sequences), e.g. the nucleotide position immediately 5' to the ATG sequence, of a nucleic acid sequence selected from SEQ ID Nos. 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700, from a variant thereof, or a corresponding RNA sequence.

In particularly preferred embodiments, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'TOP motif. As described above, the sequence extending from position 5 to the nucleotide immediately 5' to the ATG (which is located at the 3'-end of the sequences) corresponds to the 5'-UTR of said sequences.

In some embodiments, the inventive mRNA thus comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLPO, RPLP1, RPLP2, RPLP3, RPLPO, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the 5'TOP of said genes, and wherein optionally the 5'-UTR element starts at its 5'-end with a nucleotide located at position 1, 2, 3, 4, 5, 6, 7, 8, 9 or 10 downstream of the 5'terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIGi), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'-UTR element does not comprise the 5'TOP of said gene.

ATP5A1 derived 5'-UTR:

In some preferred embodiments, the 5'-UTR element comprises or consists of a nucleic acid sequence, which is derived from a 5'-UTR of a TOP gene encoding a mitochondrial ATP synthase subunit alpha or from a homolog or variant of a 5'-UTR of a TOP gene encoding a mitochondrial ATP synthase subunit alpha, preferably lacking the 5'TOP motif.

In this context, the 5'-UTR element preferably comprises or consists of a nucleic acid sequence which is derived from the 5'-UTR of a mitochondrial ATP synthase subunit alpha gene, preferably from a vertebrate mitochondrial ATP synthase subunit alpha (ATP5A1) gene, more preferably from a mammalian mitochondrial ATP synthase subunit alpha (ATP5A1) gene, most preferably from a human mitochondrial ATP synthase subunit alpha (ATP5A1) gene, or from a variant of the 5'-UTR of a mitochondrial ATP synthase subunit alpha gene, preferably from a vertebrate mitochondrial ATP synthase subunit alpha (ATP5A1) gene, more preferably from a mammalian mitochondrial ATP synthase subunit alpha (ATP5A1) gene, most preferably from a human mitochondrial ATP synthase subunit alpha (ATP5A1) gene, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3378 (5'-UTR of ATP5A1 lacking the 5' terminal oligopyrimidine tract: GCGGCTCGGCCAT-TTTGTCCCAGTCAGTCCG-GAGGCTGCGGCTGCAGAAGTACCGCCTGCG-GAGTAACTGCAAAG; corresponding to SEQ ID NO: 1414 of the patent application WO2013/143700) or preferably to a corresponding RNA sequence according to SEQ ID NO: 3379, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3378 or more preferably to a corresponding RNA sequence (SEQ ID NO: 3379), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

L32 derived 5'-UTR:

In some preferred embodiments, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element may comprise or consist of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'TOP motif.

In this context, the 5'-UTR element preferably comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'TOP of said gene.

Accordingly, in some particularly preferred embodiments, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3376 (5'-UTR of human ribosomal protein Large 32 lacking the 5' terminal oligopyrimidine tract: GGCGCTGCCTACGGAGGTGGCAGC-CATCTCCTTCTCGGCATC; corresponding to SEQ ID NO: 1368 of the patent application WO2013/143700) or preferably to a corresponding RNA sequence according to SEQ ID NO: 3377, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3376 or more preferably to a corresponding RNA sequence (SEQ ID NO: 3377), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5'-UTR element and the at least one 3'-UTR element act synergistically to increase protein production from the inventive mRNA.

Histone Stem-Loop

In particularly preferred embodiments, the inventive mRNA comprises a histone stem-loop sequence/structure. Such histone stem-loop sequences are preferably selected from histone stem-loop sequences as disclosed in WO2012/019780, the disclosure of which is incorporated herewith by reference.

A histone stem-loop sequence, suitable to be used within the present invention, is preferably selected from at least one of the following formulae (I) or (II):

formula (I) (stem-loop sequence without stem bordering elements):

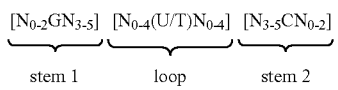

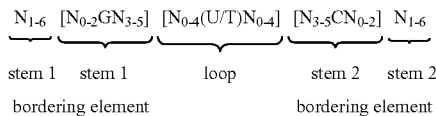

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one or more bases in one stem do not have a complementary base in the reverse complementary sequence of the other stem.

According to a further preferred embodiment, the inventive mRNA may comprise at least one histone stem-loop sequence according to at least one of the following specific formulae (Ia) or (IIa):

formula (Ia) (stem-loop sequence without stem bordering elements):

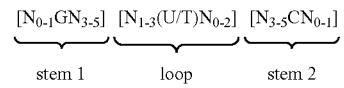

| | |
|---|---|
| stem1 or stem2 bordering elements $N_{1-6}$ | is a consecutive sequence of 1 to 6, preferably of 2 to 6, more preferably of 2 to 5, even more preferably of 3 to 5, most preferably of 4 to 5 or 5N, wherein each N is independently from another selected from a nucleotide selected from A, U, T, G and C, or a nucleotide analogue thereof; |
| stem1 $[N_{0-2}GN_{3-5}]$ | is reverse complementary or partially reverse complementary with element stem2, and is a consecutive sequence between of 5 to 7 nucleotides; wherein $N_{0-2}$ is a consecutive sequence of 0 to 2, preferably of 0 to 1, more preferably of 1N, wherein each N is independently from another selected from a nucleotide selected from A, U, T, G and C or a nucleotide analogue thereof; wherein $N_{3-5}$ is a consecutive sequence of 3 to 5, preferably of 4 to 5, more preferably of 4N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleoside cytidine in stem2 is replaced by guanosine; |
| loop sequence $[N_{0-4}(U/T)N_{0-4}]$ | is located between elements stem1 and stem2, and is a consecutive sequence of 3 to 5 nucleotides, more preferably of 4 nucleotides; wherein each $N_{0-4}$ is independent from another a consecutive sequence of 0 to 4, preferably of 1 to 3, more preferably of 1 to 2N, wherein each N is independently from another selected from a nucleotide selected from A, U, T, G and C or a nucleotide analogue thereof; and wherein U/T represents uridine, or optionally thymidine; |
| stem2 $[N_{3-5}CN_{0-2}]$ | is reverse complementary or partially reverse complementary with element stem1, and is a consecutive sequence between of 5 to 7 nucleotides; wherein $N_{3-5}$ is a consecutive sequence of 3 to 5, preferably of 4 to 5, more preferably of 4N, wherein each N is independently from another selected from a nucleotide selected from A, U, T, G and C or a nucleotide analogue thereof; wherein $N_{0-2}$ is a consecutive sequence of 0 to 2, preferably of 0 to 1, more preferably of 1N, wherein each N is independently from another selected from a nucleotide selected from A, U, T, G and C or C or a nucleotide analogue thereof; and wherein C is cytidine or an analogue thereof, and may be optionally replaced by a guanosine or an analogue thereof provided that its complementary nucleoside guanosine in stem1 is replaced by cytidine; | formula (IIa) (stem-loop sequence with stem bordering elements):

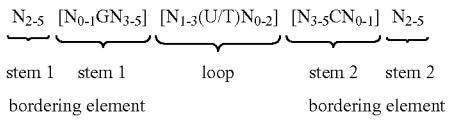

wherein:
N, C, G, T and U are as defined above.

According to a further more particularly preferred embodiment, the inventive mRNA comprises at least one histone stem-loop sequence according to at least one of the following specific formulae (Ib) or (IIb):

formula (Ib) (stem-loop sequence without stem bordering elements):

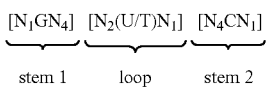

formula (IIb) (stem-loop sequence with stem bordering elements):

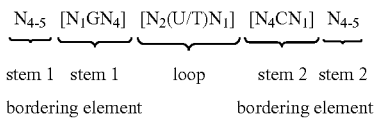

wherein:
N, C, G, T and U are as defined above.

A particularly preferred histone stem-loop sequence is the sequence CAAAGGCTCTTTTCAGAGCCACCA (according to SEQ ID NO: 3394) or more preferably the corresponding RNA sequence CAAAGGCUCUUUUCAGAGCCACCA (according to SEQ ID NO: 3395).

Accordingly, in preferred embodiments, the artificial nucleic acid of the invention comprises at least one histone stem-loop as defined herein. Preferably, the at least one histone stem loop comprises a nucleic acid sequence according to SEQ ID NOs: 3394 or 3395, or a fragment or variant thereof.

In particularly preferred embodiments, the artificial nucleic acid, preferably the artificial mRNA of the invention comprises a 3'-terminal sequence element comprising a poly(A)sequence as defined herein and a histone-stem-loop sequence as defined herein, wherein the 3'-terminal sequence element may be selected from SEQ ID NOs: 6412, 6413, 6414 or 6415.

Signal Peptides

According to particularly preferred embodiments, the inventive further encodes a secretory (signal) peptide. The sequence encoding the secretory (signal) peptide is preferably joined to the sequence encoding the antigenic peptide or protein, so that said peptide or protein is expressed as a fusion protein comprising said secretory (signal) peptide.

Such signal peptides are sequences, which typically exhibit a length of about 15 to 30 amino acids and are preferably located at the N-terminus of the encoded peptide, without being limited thereto. Signal peptides as defined herein preferably allow the transport of the antigenic peptide or protein as encoded by the inventive mRNA into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulins, signal sequences of the invariant chain of immunoglobulins or antibodies, signal sequences of Lamp1, Tapasin, Erp57, Calretikulin, Calnexin, PLAT, EPO or albumin and further membrane associated proteins or of proteins associated with the endoplasmic reticulum (ER) or the endosomal-lysosomal compartment.

Particularly preferred signal peptides are those derived from human HLA-A2 (amino acids 1-24), human PLAT (amino acids 1-23, 1-21 or 1-22), human EPO (amino acids 1-27), human ALB (amino acids 1-18), human IgE, human CD5 (amino acids 1-24), human IL2(amino acids 1-20), human CTRB2(amino acids 1-18), human IgG-HC (amino acids 1-19), human Ig-HC (amino acids 1-19), human Ig-LC (amino acids 1-19), *Gaussia princeps* Luc (amino acids 1-17), mouse Igkappa, NrChitl(1-26) CILp1.1(1-21) Nepenthes rafflesiana Nep1 (amino acids 1-24), human Azul(amino acids 1-19), human CD33(amino acids 1-16), *Vibrio cholera* CtxB (amino acids 1-19), human CST4 (amino acids 1-20), human Ins-iso1 (amino acids 1-24), human SPARC (amino acids 1-17), or Influenza A SP-H1N1 (Netherlands2009)-HA.

Such signal peptides are preferably used to promote secretion of the encoded antigenic peptide or protein.

According to particularly preferred embodiments, the inventive RNA comprises a coding region encoding a signal peptide as defined herein. Said coding region is preferably joined to or comprised by the coding region encoding the antigenic peptide or protein as defined herein, so that the antigenic protein or peptide is expressed as a fusion protein comprising the encoded signal peptide.

Accordingly, particularly preferred embodiments, the inventive mRNA additionally comprises at least one coding region encoding a signal peptide as defined herein, said signal peptide preferably comprising or consisting of an amino acid sequence as defined by SEQ ID NO: 3399-3423, or a variant or fragment thereof. Such variants or fragments are preferably functional, i.e. exhibit the same desired biological function as the signal peptides they are derived from, and are thus preferably capable of mediating secretion of the fused antigenic protein or peptide.

Transmembrane Domains

According to further particularly preferred embodiments, the inventive mRNA further encodes a transmembrane domain. The sequence encoding the transmembrane domain is preferably joined to the sequence encoding the antigenic peptide or protein, so that said peptide or protein is expressed as a fusion protein comprising said transmembrane domain.

Transmembrane domains (TMDs) consist of amino acid sequences forming three-dimensional protein structures that span the lipid bilayer. TMDs are typically about 20 amino acids in length and can form a single alpha helix, a transmembrane beta barrel, a beta-helix of gramicidin A, or any other structure.

Transmembrane domains as defined herein preferably anchor the fused antigenic protein or peptide in a membrane. Such transmembrane domains may be useful to ensure that the antigenic proteins or peptides are membrane-bound and thus accessible for the immune system.

Particularly preferred transmembrane domains are those derived from Influenza virus, Human immunodeficiency virus 1, equine infectious anemia virus, murine leukemia virus, mouse mammary tumor virus, vesicular stomatitis virus and rabies virus.

According to particularly preferred embodiments, the inventive mRNA comprises a coding region encoding a TMD as defined herein. Said coding region is preferably joined to or comprised by the coding region encoding the antigenic peptide or protein as defined herein, so that the antigenic protein or peptide is expressed as a fusion protein comprising the encoded TMD.

Accordingly, particularly preferred embodiments, the inventive mRNA additionally comprises at least one coding region encoding a TMD as defined herein, said TMD preferably comprising or consisting of an amino acid sequence as defined by SEQ ID NO: 3424-3435, or a variant or fragment thereof. Such variants or fragments are preferably functional, i.e. exhibit the same desired biological function as the TMDs they are derived from, and are thus preferably capable of anchoring the fused antigenic protein or peptide in a membrane. Said membrane can be a cellular membrane or a virus-like particle membrane.

VLP-Forming Domains

According to further particularly preferred embodiments, the inventive mRNA further encodes a VLP-forming domain. The sequence encoding the VLP-forming domains preferably joined to the sequence encoding the antigenic peptide or protein, so that said peptide or protein is expressed as a fusion protein comprising said VLP-forming domain.

VLP-forming domains are capable of mediating the formation of virus-like particles (VLPs), i.e. non-infectious assemblies of viral structural proteins. VLPs preferably contain repetitive, high density displays of viral structural proteins that can elicit strong adaptive immune responses.

VLP-forming domains can therefore be fused to antigenic peptides or proteins as defined herein in order to mediate their assembly into VLPs.

Particularly preferred VLP-forming domains are those derived from Woodchuck hepatitis virus and Alfalfa mosaic virus.

According to particularly preferred embodiments, the inventive RNA comprises a coding region encoding a VLP-forming domain as defined herein. Said coding region is preferably joined to or comprised by the coding region encoding the antigenic peptide or protein as defined herein, so that the antigenic protein or peptide is expressed as a fusion protein comprising the encoded VLP-forming domain.

Accordingly, particularly preferred embodiments, the inventive mRNA additionally comprises at least one coding region encoding a VLP-forming domain as defined herein, said TMD preferably comprising or consisting of an amino acid sequence as defined by SEQ ID NO: 3436 or 3437, or a variant or fragment thereof. Such variants or fragments are preferably functional, i.e. exhibit the same desired biological function as the VLP-forming domains they are derived from, and are thus preferably capable of mediating the assembly of the fused antigenic proteins or peptides into VLPs.

Any of the above modifications may be applied to the mRNA of the present invention, and may be, if suitable or necessary, be combined with each other in any combination, provided, these combinations of modifications do not interfere with each other in said mRNA. A person skilled in the art will be able to take his choice accordingly.

RNA Constructs

The inventive mRNA, which comprises at least one coding sequence as defined herein may preferably comprise a 5'-UTR and/or a 3'-UTR optionally containing at least one histone stem-loop.

The 3'-UTR of the mRNA preferably comprises also a poly(A) and/or a poly(C) sequence as defined herein. The single elements of the 3'-UTR may occur therein in any order from 5' to 3' along the sequence of the mRNA.

In addition, further elements as described herein, may also be contained, such as a stabilizing sequence as defined herein (e.g. derived from the UTR of a globin gene), IRES sequences, etc. Each of the elements may also be repeated in the mRNA at least once (particularly in di- or multicistronic constructs), preferably twice or more. As an example, the single elements may be present in the inventive mRNA in the following order:

5'—Coding Sequence—Histone Stem-Loop—Poly(A)/(C) Sequence—3'; or

5'—coding sequence—poly(A)/(C) sequence—histone stem-loop—3'; or

5'—Coding Sequence—Histone Stem-Loop—Polyadenylation Signal—3'; or

5'—coding sequence—polyadenylation signal—histone stem-loop—3'; or

5'—Coding Sequence—Histone Stem-Loop—Histone Stem-Loop—Poly(A)/(C) Sequence—3'; or 5'—coding sequence—histone stem-loop—histone stem-loop—polyadenylation signal—3'; or 5'—Coding Sequence—Stabilizing Sequence—Poly(A)/(C) Sequence—Histone Stem-Loop—3'; or 5'—coding sequence—stabilizing sequence—poly(A)/(C) sequence—poly(A)/(C) sequence—histone stem-loop-3'; etc.

According to further embodiments, the inventive mRNA preferably comprises at least one of the following structural elements: a 5'- and/or 3'—untranslated region element (UTR element), particularly a 5'-UTR element, which preferably comprises or consists of a nucleic acid sequence which is derived from the 5'-UTR of a TOP gene or from a fragment, homolog or a variant thereof, or a 5'- and/or 3'-UTR element which may preferably be derivable from a gene that provides a stable mRNA or from a homolog, variant or fragment thereof; a histone-stem-loop structure, preferably a histone-stem-loop in its 3' untranslated region; a 5'-cap structure; a poly-A tail; or a poly(C) sequence.

It may be particularly preferred that if, in addition to an antigenic peptide or protein as defined herein, a further peptide or protein is encoded by the at least one coding sequence as defined herein, the encoded peptide or protein is preferably no histone protein, no reporter protein (e.g. Luciferase, GFP, EGFP, beta-galactosidase, particularly EGFP) and/or no marker or selection protein (e.g. alpha-globin, galactokinase and Xanthine:Guanine phosphoribosyl transferase (GPT)). Thus, in some preferred embodiments, the inventive mRNA does not comprise a reporter gene or a marker gene. Preferably, the mRNA does not encode, for instance, luciferase; green fluorescent protein (GFP) and its variants (such as eGFP, RFP or BFP); alpha-globin; hypoxanthine-guanine phosphoribosyltransferase (HGPRT); beta-galactosidase; galactokinase; alkaline phosphatase; secreted embryonic alkaline phosphatase (SEAP)) or a resistance gene (such as a resistance gene against neomycin, puromycin, hygromycin and zeocin). In preferred embodiments, the inventive mRNA does not encode luciferase. In other embodiments, the inventive mRNA does not encode GFP or a variant thereof.

In preferred embodiments the nucleic acid sequence, in particular, the RNA sequence comprises, preferably in 5'- to 3'-direction, the following elements:
a) 5'-cap structure, preferably as defined herein;
b) optionally, 5'-UTR element, preferably as defined herein;
c) at least one coding sequence, preferably as defined herein;
d) a 3'-UTR element, preferably as defined herein;
e) optionally, poly(A) sequence, preferably as defined herein;
f) optionally, poly(C) sequence, preferably as defined herein;
g) optionally, a histone stem-loop, preferably as defined herein; and
h) optionally, a 3'-terminal sequence element as defined herein.

According to preferred embodiments, the mRNA comprises, preferably in 5' to 3' direction, the following elements:
a) a 5'-cap structure, preferably m7GpppN,
b) at least one coding region encoding an antigenic protein or peptide as defined herein,
c) a poly(A) tail, preferably consisting of 10 to 200, 10 to 100, 40 to 80 or 50 to 70 adenosine nucleotides,
d) a poly(C) tail, preferably consisting of 10 to 200, 10 to 100, 20 to 70, 20 to 60 or 10 to 40 cytosine nucleotides, and
e) a histone stem-loop, preferably comprising the RNA sequence according to SEQ ID NO: 3395.
f) optionally, a poly(A) sequence and a histone stem-loop comprising the RNA sequence according to SEQ ID NOs: 6412, 6413, 6414 or 6415

More preferably, the mRNA comprises, preferably in 5' to 3' direction, the following elements:
a) a 5'-cap structure, preferably m7GpppN,
b) at least one coding region encoding an antigenic protein or peptide as defined herein,
c) a 3'-UTR element comprising a nucleic acid sequence, which is derived from an alpha-globin gene, preferably comprising the corresponding RNA sequence of the nucleic acid sequence according to SEQ ID NO: 3386, or a homolog, a fragment or a variant thereof,
d) a poly(A) tail, preferably consisting of 10 to 200, 10 to 100, 40 to 80 or 50 to 70 adenosine nucleotides,
e) a poly(C) tail, preferably consisting of 10 to 200, 10 to 100, 20 to 70, 20 to 60 or 10 to 40 cytosine nucleotides, and
f) a histone stem-loop, preferably comprising the RNA sequence according to SEQ ID NO: 3395, and
g) optionally, a poly(A) sequence and a histone stem-loop comprising the RNA sequence according to SEQ ID NOs: 6412, 6413, 6414 or 6415

More preferably, the mRNA comprises, preferably in 5' to 3' direction, the following elements:
a) a 5'-cap structure, preferably m7GpppN,
b) at least one coding region encoding an antigenic protein or peptide derived from a Lassa virus protein or peptide or a fragment or variant thereof, preferably comprising or consisting of any one of the nucleic acid sequences according to SEQ ID NO: 376-561, 751-936, 1126-1311, 1501-1686, 1876-2061, 2251-2436, 2626-2811 or 3001-3186, or 562-750, 937-1125, 1312-1500, 1687-1875, 2062-2250, 2437-2625, 2812-3000 or 3187-3375, or 3604-3756, 3757-3909, 3910-4062, 4063-4215, 4216-4368, 4369-4521, 4522-4674, 4675-4827, or a fragment or variant thereof.
c) a 3'-UTR element comprising a nucleic acid sequence, which is derived from an alpha-globin gene, preferably comprising the corresponding RNA sequence of the nucleic acid sequence according to SEQ ID NO: 3386, or a homolog, a fragment or a variant thereof,
d) a poly(A) tail, preferably consisting of 10 to 200, 10 to 100, 40 to 80 or 50 to 70 adenosine nucleotides,
e) a poly(C) tail, preferably consisting of 10 to 200, 10 to 100, 20 to 70, 20 to 60 or 10 to 40 cytosine nucleotides, and
f) a histone stem-loop, preferably comprising the RNA sequence according to SEQ ID NO: 3395, and
g) optionally, a poly(A) sequence and a histone stem-loop comprising the RNA sequence according to SEQ ID NOs: 6412, 6413, 6414 or 6415

In further preferred embodiments, the inventive mRNA comprises, preferably in 5' to 3' direction, the following elements:
a) a 5'-cap structure, preferably m7GpppN,
b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 3376, or a homolog, a fragment or a variant thereof,
c) at least one coding region encoding an antigenic protein or peptide as defined herein,
d) a 3'-UTR element comprising a nucleic acid sequence, which is preferably derived from an alpha-globin gene, preferably comprising the corresponding RNA sequence of the nucleic acid sequence according to SEQ ID NO: 3386, or a homolog, a fragment or a variant thereof, and/or a 3'-UTR element comprising a nucleic acid sequence, which is derived from an albumin gene, preferably comprising the corresponding RNA sequence of the nucleic acid sequence according to SEQ ID NO: 3390 or 3392, or a homolog, a fragment or a variant thereof,
e) a poly(A) tail, preferably consisting of 10 to 200, 10 to 100, 40 to 80 or 50 to 70 adenosine nucleotides,
f) a poly(C) tail, preferably consisting of 10 to 200, 10 to 100, 20 to 70, 20 to 60 or 10 to 40 cytosine nucleotides, and
g) a histone stem-loop, preferably comprising the RNA sequence according to SEQ ID NO: 3395.

In further preferred embodiments, the inventive mRNA comprises, preferably in 5' to 3' direction, the following elements:
a) a 5'-cap structure, preferably m7GpppN,
b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 3376, or a homolog, a fragment or a variant thereof,
c) at least one coding region encoding an antigenic protein or peptide derived from a Lassa virus protein or peptide or a fragment or variant thereof, preferably comprising or consisting of any one of the nucleic acid sequences according to SEQ ID NO: 376-561, 751-936, 1126-1311, 1501-1686, 1876-2061, 2251-2436, 2626-2811 or 3001-3186, or 562-750, 937-1125, 1312-1500, 1687-1875, 2062-2250, 2437-2625, 2812-3000 or 3187-3375, or 3604-3756, 3757-3909, 3910-4062, 4063-4215, 4216-4368, 4369-4521, 4522-4674, 4675-4827, or a fragment or variant thereof.

d) a 3'-UTR element comprising a nucleic acid sequence, which is preferably derived from an alpha-globin gene, preferably comprising the corresponding RNA sequence of the nucleic acid sequence according to SEQ ID NO: 3386, or a homolog, a fragment or a variant thereof; and/or a 3'-UTR element comprising a nucleic acid sequence, which is derived from an albumin gene, preferably comprising the corresponding RNA sequence of the nucleic acid sequence according to SEQ ID NO: 3390 or 3392, or a homolog, a fragment or a variant thereof, e) a poly(A) tail, preferably consisting of 10 to 200, 10 to 100, 40 to 80 or 50 to 70 adenosine nucleotides, f) a poly(C) tail, preferably consisting of 10 to 200, 10 to 100, 20 to 70, 20 to 60 or 10 to 40 cytosine nucleotides, and g) a histone stem-loop, preferably comprising the RNA sequence according to SEQ ID NO: 3395.

Preferred Lassa virus constructs of the invention:

In the following, preferred and particularly suitable Lassa virus mRNA sequences of the invention are provided.

Preferred Lassa virus polypeptide, nucleic acid and mRNA sequences are provided in Table 1-3 (in the columns D, E and F). Therein, each row represents a specific suitable Lassa virus construct of the invention. Accession numbers are provided in the <223>identifier of the respective SEQ ID NOs in the sequence listing. Each column A provides the respective SEQ ID NOs of the protein constructs as provided in the sequence listing. mRNA constructs comprising coding sequences encoding said proteins are provided in column D "SEQ ID NO: mRNA design 1" column E "SEQ ID NO: mRNA design 2" and column F "SEQ ID NO: mRNA design 3". Additional information regarding each of the sequences provided in Table 1-3 may also be derived from the sequence listing, in particular from the details provided therein under identifier <223>.

Accordingly, it is particularly preferred that the mRNA according to the invention comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 4828-5013, 5014-5202 or 5203-5355 (column 5 D "mRNA design 1", Table 1-3) or a fragment or variant of any of these sequences.

Accordingly, it is particularly preferred that the mRNA according to the invention comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 5356-5541, 5542-5730 or 5731-5883 (column 5 E "mRNA design 2", Table 1-3) or a fragment or variant of any of these sequences.

Accordingly, it is particularly preferred that the mRNA according to the invention comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 5884-6069, 6070-6259 or 6259-6411 (column 7 F "mRNA design 3", Table 1-3) or a fragment or variant of any of these sequences.

Accordingly, it is particularly preferred that the mRNA according to the invention comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 5541, 5729, 5731, 5529, 5356, 5540 or 5013 or a fragment or variant of any of these sequences.

(Pharmaceutical) Composition

In a further aspect, the present invention provides a composition comprising the mRNA of the invention, and at least one pharmaceutically acceptable carrier. The composition according to the invention is preferably provided as a pharmaceutical composition or as a vaccine.

A "vaccine" is typically understood to be a prophylactic or therapeutic material providing at least one epitope of an antigen, preferably an immunogen. "Providing at least on epitope" means, for example, that the vaccine comprises the epitope (or antigen comprising or providing said epitope) or that the vaccine comprises a molecule that, e.g., codes for the epitope or an antigen comprising or providing the epitope. The antigen preferably stimulates the adaptive immune system to provide an adaptive immune response.

The (pharmaceutical) composition or vaccine provided herein may further comprise at least one pharmaceutically acceptable excipient, adjuvant or further component (e.g. additives, auxiliary substances, and the like).

Plurality of mRNA

In preferred embodiments, the (pharmaceutical) composition or vaccine according to the invention comprises a plurality or more than one of the inventive mRNAs.

In some embodiments, each of the mRNAs comprises a coding region encoding at least one different antigenic peptide or protein derived from proteins of the same lassa virus. In other embodiments, each of the mRNAs comprises a coding region which encodes at least one different antigenic peptide or protein derived from different proteins of the same lassa virus. In some embodiments, each of the mRNAs comprises a coding region which encodes at least one different antigenic peptide or protein derived from different proteins of different lassa viruses (e.g. clade I and II or lineage I and II. In a preferred embodiment, each of the mRNAs comprises a coding region which encodes at least one different antigenic peptide or protein derived from proteins of the different lassa virus clades or lineages (e.g. of clade I, II, III and IV or of lineage I, II, III and IV).

In said embodiments, the antigenic peptides or proteins are preferably derived from glycoprotein precursor (GPC) of a lassa virus, or a variant or fragment thereof, and/or nucleoprotein (NP) of a lassa virus, and/or zinc-binding matrix protein (Z) of a lassa virus, or a variant or fragment thereof.

In a preferred embodiment, the antigenic peptides or proteins are derived from glycoprotein precursor (GPC) of a lassa virus, or a variant or fragment thereof, and nucleoprotein (NP) of a lassa virus, and zinc-binding matrix protein (Z) of a lassa virus, or a variant or fragment thereof.

In a preferred embodiment, the antigenic peptides or proteins are derived from glycoprotein precursor (GPC) of a lassa virus, or a variant or fragment thereof and nucleoprotein (NP) of a lassa virus, or a variant or fragment thereof.

In a further preferred embodiment, the antigenic peptides or proteins are derived from glycoprotein precursor (GPC) of a lassa virus, or a variant or fragment thereof and zinc-binding matrix protein (Z) of a lassa virus, or a variant or fragment thereof.

Specifically, said nucleoprotein (NP) and/or glycoprotein precursor (GPC), and/or zinc-binding matrix protein (Z) encoded by the plurality of mRNAs may be derived from 2, 3, 4 or more different lassa viruses, preferably derived from 2, 3, 4 or more different lassa clades or lassa lineages, or may be derived from the same lassa virus.

In a further preferred embodiment, the antigenic peptides or proteins are derived from glycoprotein precursor (GPC) of a lassa virus, or a variant or fragment thereof, wherein the lassa virus peptides or proteins are derived from at least two different lassa virus strains of clade I, II, III and/or IV or from a lassa virus of lineage I, II, III and/or IV. In a specific embodiment, the at least two lassa virus proteins exhibit considerable sequence dissimilarities. In a further preferred embodiment, the dissimilarities are greater than 11% amino acid sequence divergence in the region of the NP gene. In a second embodiment, the sequence divergence of the mRNA encoding the lassa virus protein is greater than 22% nucleotide sequence divergence.

In a preferred embodiment, the antigenic peptides or proteins are derived from glycoprotein precursor (GPC) of a lassa virus, or a variant or fragment thereof, wherein the lassa virus peptides or proteins are derived from four different lassa virus strains of clade I, II, III and IV, wherein the lassa virus strains are selected from Josiah (clade IV), LP (clade I), 803213 (clade II), and GA391 (clade III).

In a further preferred embodiment, each of the mRNAs comprises a coding region encoding at least GPC derived from proteins of different lassa viruses, wherein the lassa virus peptides or proteins are derived from four different lassa virus strains of clade I, II, III and IV, preferably the mRNA comprises or consists of an RNA sequence which is identical or at least 50%, 60%, 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 5541, 5529, 5356, 5540 and 5729.

Accordingly, the (pharmaceutical) composition or vaccine according to the invention may comprise an mRNA as defined herein, wherein said mRNA encodes one specific antigenic peptide or protein as defined herein. In such embodiments, the (pharmaceutical) composition or vaccine preferably comprises an inventive mRNA comprising the at least one coding sequence as defined herein encoding said antigenic peptide or protein.

Alternatively, the (pharmaceutical) composition or vaccine of the present invention may comprise, an mRNA as defined herein, wherein said mRNA encodes at least two, three, four, five, six, seven, eight, nine, ten, eleven or twelve distinct antigenic peptides or proteins (or variants or fragments thereof) as defined herein. In such embodiments, the (pharmaceutical) composition or vaccine preferably comprises several species of the inventive mRNA, wherein each mRNA species encodes a distinct antigenic peptide or protein as defined herein.

In other embodiments, the plurality of mRNAs comprised in the (pharmaceutical) composition or vaccine encode at least one antigenic peptide or protein derived from glycoprotein precursor (GPC) and/or nucleoprotein (NP) and/or zinc-binding matrix protein (Z) of 2, 3, 4, 5, 6, 7, 6, 9, 10, 11, 12, 13, 14, 15, 16, 17, 18, 19, 20, 25, 30, 35, 40, 45, 50, 60, 70, 80, or 100 different lassa viruses.

In other embodiments, the mRNA comprised in the (pharmaceutical) composition or vaccine is a bi- or multicistronic mRNA as defined herein, which encodes the at least two, three, four, five, six, seven, eight, nine, ten, eleven or twelve distinct antigenic peptides or proteins as defined herein.

Mixtures between these embodiments are also envisaged, such as compositions comprising more than one mRNA species, wherein at least one mRNA species may be monocistronic, while at least one other mRNA species may be bi- or multicistronic.

Complexation

In preferred embodiments, the inventive mRNA, optionally comprised by the (pharmaceutical) composition or vaccine, of the invention, is provided in a complexed form, i.e. complexed or associated with one or more (poly-)cationic compounds, preferably with (poly-)cationic polymers, (poly-)cationic peptides or proteins, e.g. protamine, (poly-)cationic polysaccharides and/or (poly-)cationic lipids. In this context, the terms "complexed" or "associated" refer to the essentially stable combination of said mRNA with one or more of the aforementioned compounds into larger complexes or assemblies without covalent binding.

Lipids

According to preferred embodiments, the mRNA, optionally comprised by the (pharmaceutical) composition or vaccine, is complexed or associated with lipids (in particular cationic and/or neutral lipids) to form one or more liposomes, lipoplexes, lipid nanoparticles, or nanoliposomes.

Therefore, in some embodiments, the at least one mRNA, optionally comprised by the (pharmaceutical) composition or vaccine, is provided in the form of a lipid-based formulation, in particular in the form of liposomes, lipoplexes, and/or lipid nanoparticles comprising said mRNA.

Lipid Nanoparticles:

According to some preferred embodiments, the mRNA, optionally comprised by the (pharmaceutical) composition or vaccine, is complexed or associated with lipids (in particular cationic and/or neutral lipids) to form one or more lipid nanoparticles.

In the context of the present invention, the term "lipid nanoparticle", also referred to as "LNP", is not restricted to any particular morphology, and includes any morphology generated when a cationic lipid and optionally one or more further lipids are combined, e.g. in an aqueous environment and/or in the presence of an RNA. For example, a liposome, a lipid complex, a lipoplex, an emulsion, a micelle, a lipidic nanocapsule, a nanosuspension and the like are within the scope of a lipid nanoparticle (LNP).

Preferably, lipid nanoparticles (LNPs) comprise: (a) at least one mRNA, optionally comprised by the (pharmaceutical) composition or vaccine as defined herein, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In some embodiments, LNPs comprise, in addition to the at least one mRNA, optionally comprised by the (pharmaceutical) composition or vaccine as defined herein, (i) at least one cationic lipid; (ii) a neutral lipid; (iii) a sterol, e.g., cholesterol; and (iv) a PEG-lipid, in a molar ratio of about 20-60% cationic lipid: 5-25% neutral lipid: 25-55% sterol; 0.5-15% PEG-lipid.

In some embodiments, the inventive mRNA, optionally comprised by the (pharmaceutical) composition or vaccine, may be formulated in an aminoalcohol lipidoid. Aminoalcohol lipidoids which may be used in the present invention may be prepared by the methods described in U.S. Pat. No. 8,450,298, herein incorporated by reference in its entirety. Ionizable lipids can also be the compounds as disclosed in Tables 1, 2 and 3 and claims 1-24 of International Publication No. WO2017/075531 A1, hereby incorporated by reference in its entirety. In another embodiment, ionizable lipids can also be the compounds as disclosed in International Publication No. WO2015/074085 A1 (i.e. ATX-001 to ATX-032 or the compounds as mentioned in claims 1-26), U.S. Appl. Nos. 61/905,724 and U.S. Ser. No. 15/614,499 or U.S. Pat. Nos. 9,593,077 and 9,567,296 hereby incorporated by reference in their entirety.

(i) Cationic Lipids

LNPs may include any cationic lipid suitable for forming a lipid nanoparticle. Preferably, the cationic lipid carries a net positive charge at about physiological pH.

The cationic lipid may be an amino lipid. As used herein, the term "amino lipid" is meant to include those lipids having one or two fatty acid or fatty alkyl chains and an amino head group (including an alkylamino or dialkylamino group) that may be protonated to form a cationic lipid at physiological pH.

The cationic lipid may be, for example, N,N-dioleyl-N, N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-di-γ-linolenyloxy-N,N-dimethylaminopropane (γ-DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DM A), 2,2-Dilinoleyl-4-dimethylaminomethyl-[1,3]—dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine, (6Z,9Z,28Z,31Z)-heptatriaconta-6,9,28,31-tetraen-19-yl 4-(dimethylamino) butanoate (MC3), 1,1'-(2-(4-(2-((2-(bis(2-hydroxydodecyl) amino)ethyl) (2-hydroxydodecyl)amino)ethyl)piperazin-1-yl) ethylazanediyl)didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), (6Z,9Z,28Z,31Z)-heptatriaconta-6,9,28,31-tetraen-19-yl 4-(dimethylamino) butanoate (DLin-M-C3-DMA), 3-((6Z,9Z,28Z,31Z)-heptatriaconta-6,9,28,31-tetraen-19-yloxy)-N,N-dimethylpropan-1-amine (MC3 Ether), 4-((6Z,9Z,28Z,31Z)-heptatriaconta-6,9,28,31-tetraen-19-yloxy)-N,N-dimethylbutan-1-amine (MC4 Ether), or any combination of any of the foregoing.

Other cationic lipids include, but are not limited to, N,N-distearyl-N,N-dimethylammonium bromide (DDAB), 3β-(N-(N',N'-dimethylaminoethane)-carbamoyl)cholesterol (DC-Choi), N-(1-(2,3-dioleyloxy)propyl)-N-2-(sperminecarboxamido)ethyl)-N,N-dimethylammonium trifluoroacetate (DOSPA), dioctadecylamidoglycyl carboxyspermine (DOGS), 1,2-dileoyl-sn-3-phosphoethanolamine (DOPE), 1,2-dioleoyl-3-dimethylammonium propane (DODAP), N-(1,2-dimyristyloxyprop-3-yl)-N,N-dimethyl-N-hydroxyethyl ammonium bromide (DMRIE), and 2,2-Dilinoleyl-4-dimethylaminoethyl-[1,3]-dioxolane (XTC). Additionally, commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/ BRL).

Other suitable (cationic) lipids are disclosed in WO2009/ 086558, WO2009/127060, WO2010/048536, WO2010/ 054406, WO2010/088537, WO2010/129709, WO2011/ 153493, US2011/0256175, US2012/0128760, US2012/ 0027803, and U.S. Pat. No. 8,158,601. In that context, the disclosures of WO2009/086558, WO2009/127060, WO2010/048536, WO2010/054406, WO2010/088537, WO2010/129709, WO2011/153493, US2011/0256175, US2012/0128760, US2012/0027803, and U.S. Pat. No. 8,158,601 are incorporated herewith by reference.

In some aspects, the lipid is selected from the group consisting of 98N12-5, C12-200, and ckk-E12.

The cationic lipid may also be an amino lipid. Suitable amino lipids include those having alternative fatty acid groups and other dialkylamino groups, including those in which the alkyl substituents are different (e.g., N-ethyl-N-methylamino-, and N-propyl-N-ethylamino-). In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of C14 to C22 may be used. Other scaffolds can also be used to separate the amino group and the fatty acid or fatty alkyl portion of the amino lipid.

Representative amino lipids include, but are not limited to, 1,2-dilinoleyoxy-3-(dimethylamino)acetoxypropane (DLin-DAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA.Cl), 1,2-dilinoleoyl-3-trimethylaminopropane chloride salt (DLin-TAP.Cl), 1,2-dilinoleyloxy-3-(N-methylpiperazino)propane (DLin-MPZ), 3-(N,Ndilinoleylamino)-1,2-propanediol (DLinAP), 3-(N,N-dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[1,3]-dioxolane (DLin-KC2-DMA); dilinoleyl-methyl-4-dimethylaminobutyrate (DLin-MC3-DMA); MC3 (US20100324120).

In some embodiments, amino or cationic lipids have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwitterionic, are not excluded from use in the invention.

In some embodiments, the protonatable lipids have a pKa of the protonatable group in the range of about 4 to about 11, e.g., a pKa of about 5 to about 7.

LNPs can include two or more cationic lipids. The cationic lipids can be selected to contribute different advantageous properties. For example, cationic lipids that differ in properties such as amine pKa, chemical stability, half-life in circulation, half-life in tissue, net accumulation in tissue, or toxicity can be used in the LNP. In particular, the cationic lipids can be chosen so that the properties of the mixed-LNP are more desirable than the properties of a single-LNP of individual lipids.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the lipid nanoparticle). In some embodiments, the ratio of cationic lipid to nucleic acid is from about 3 to about 15, such as from about 5 to about 13 or from about 7 to about 11.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the RNA which is used as cargo. The N/P ratio may be calculated on the basis that, for example, 1 µg RNA typically contains about 3nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

In certain embodiments, the LNP comprises one or more additional lipids which stabilize the formation of particles during their formation.

(ii) Neutral and Non-Cationic Lipids

The non-cationic lipid can be a neutral lipid, an anionic lipid, or an amphipathic lipid. Neutral lipids, when present, can be any of a number of lipid species which exist either in an uncharged or neutral zwitterionic form at physiological pH. Such lipids include, for example, diacylphosphatidylcholine, diacylphosphatidylethanolamine, ceramide, sphingomyelin, dihydrosphingomyelin, cephalin, and cerebrosides. The selection of neutral lipids for use in the particles described herein is generally guided by consideration of, e.g., LNP size and stability of the LNP in the bloodstream. Preferably, the neutral lipid is a lipid having two acyl groups (e.g., diacylphosphatidylcholine and diacylphosphatidylethanolamine).

In some embodiments, the neutral lipids contain saturated fatty acids with carbon chain lengths in the range of C10 to C20. In other embodiments, neutral lipids with mono- or di-unsaturated fatty acids with carbon chain lengths in the range of C10 to C20 are used. Additionally, neutral lipids having mixtures of saturated and unsaturated fatty acid chains can be used.

Suitable neutral lipids include, but are not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), dimyristoyl phosphatidylcholine (DMPC), distearoyl-phosphatidyl-ethanolamine (DSPE), SM, 16—O-monomethyl PE, 16—O-dimethyl PE, 18-1-trans PE, 1-stearoyl-2-oleoyl-phosphatidyethanolamine (SOPE), cholesterol, or a mixture thereof. Anionic lipids suitable for use in LNPs include, but are not limited to, phosphatidylglycerol, cardiolipin, diacylphosphatidylserine, diacylphosphatidic acid, N-dodecanoyl phosphatidylethanoloamine, N-succinyl phosphatidylethanolamine, N-glutaryl phosphatidylethanolamine, lysylphosphatidylglycerol, and other anionic modifying groups joined to neutral lipids.

In one embodiment, the neutral lipid is 1,2-distearoyl-sn-glycero-3phosphocholine (DSPC).

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

Amphipathic lipids refer to any suitable material, wherein the hydrophobic portion of the lipid material orients into a hydrophobic phase, while the hydrophilic portion orients toward the aqueous phase. Such compounds include, but are not limited to, phospholipids, aminolipids, and sphingolipids. Representative phospholipids include sphingomyelin, phosphatidylcholine, phosphatidylethanolamine, phosphatidylserine, phosphatidylinositol, phosphatidic acid, palmitoyloleoyl phosphatdylcholine, lysophosphatidylcholine, lysophosphatidylethanolamine, dipalmitoylphosphatidylcholine, dioleoylphosphatidylcholine, distearoylphosphatidylcholine, or dilinoleoylphosphatidylcholine. Other phosphorus-lacking compounds, such as sphingolipids, glycosphingolipid families, diacylglycerols, and beta-acyloxyacids, can also be used.

In some embodiments, the non-cationic lipid is present in a ratio of from about 5 mol % to about 90 mol %, about 5 mol % to about 10 mol %, about 5, 10, 15, 20, 25, 30, 35, 40, 45, 50, 55, 60, 65, 70, 75, 80, 85, or about 90 mol % of the total lipid present in the LNP.

In some embodiments, LNPs comprise from about 0% to about 15 or 45% on a molar basis of neutral lipid, e.g., from about 3 to about 12% or from about 5 to about 10%. For instance, LNPs may include about 15%, about 10%, about 7.5%, or about 7.1% of neutral lipid on a molar basis (based upon 100% total moles of lipid in the LNP).

(iii) Sterols

The sterol is preferably cholesterol.

The sterol can be present in a ratio of about 10 mol % to about 60 mol % or about 25 mol % to about 40 mol % of the LNP. In some embodiments, the sterol is present in a ratio of about 10, 15, 20, 25, 30, 35, 40, 45, 50, 55, or about 60 mol % of the total lipid present in the LNP. In other embodiments, LNPs comprise from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the LNP).

(iv) Aggregation Reducing Agents

The aggregation reducing agent can be a lipid capable of reducing aggregation.

Examples of such lipids include, but are not limited to, polyethylene glycol (PEG)-modified lipids, monosialoganglioside Gml, and polyamide oligomers (PAO) such as those described in U.S. Pat. No. 6,320,017, which is incorporated by reference in its entirety. Other compounds with uncharged, hydrophilic, steric-barrier moieties, which prevent aggregation during formulation, like PEG, Gml or *ATTA*, can also be coupled to lipids. *ATTA*-lipids are described, e.g., in U.S. Pat. No. 6,320,017, and PEG-lipid conjugates are described, e.g., in U.S. Pat. Nos. 5,820,873, 5,534,499, 5,885,613, US20150376115A1 and WO2015/199952, each of which is incorporated by reference in its entirety.

The aggregation reducing agent may be, for example, selected from a polyethyleneglycol (PEG)-lipid including, without limitation, a PEG-diacylglycerol (DAG), a PEG-dialkylglycerol, a PEG-dialkyloxypropyl (DAA), a PEG-phospholipid, a PEG-ceramide (Cer), or a mixture thereof (such as PEG-Cerl4 or PEG-Cer20). The PEG-DAA conjugate may be, for example, a PEG-dilauryloxypropyl (C12), a PEG-dimyristyloxypropyl (C14), a PEG-dipalmityloxypropyl (C16), or a PEG-distearyloxypropyl (C18). Other pegylated-lipids include, but are not limited to, polyethylene glycol-didimyristoyl glycerol (C14-PEG or PEG-C14, where PEG has an average molecular weight of 2000 Da) (PEG-DMG); (R)-2,3-bis(octadecyloxy)propyl-1-(methoxy poly(ethylene glycol)2000)propylcarbamate) (PEG-DSG); PEG-carbamoyl-1,2-dimyristyloxypropylamine, in which PEG has an average molecular weight of 2000 Da (PEG-cDMA); N-Acetylgalactosamine-((R)-2,3-bis(octadecyloxy)propyl-1-(methoxy poly(ethylene glycol)2000)propylcarbamate)) (GalNAc-PEG-DSG); mPEG (mw2000)-diastearoylphosphatidyl-ethanolamine (PEG-DSPE); and polyethylene glycol-dipalmitoylglycerol (PEG-DPG).

In some embodiments, the aggregation reducing agent is PEG-DMG. In other embodiments, the aggregation reducing agent is PEG-c-DMA.

In various embodiments, the molar ratio of the cationic lipid to the PEGylated lipid ranges from about 100:1 to about 25:1.

its size. In one example by Semple et al. (Semple et al. Nature Biotech. 2010 28: 172-176; herein incorporated by reference in its entirety), the LNP composition was composed of 57.1% cationic lipid, 7.1% dipalmitoylphosphatidylcholine, 34.3% cholesterol, and 1.4% PEG-c-DMA (Basha et al. Mol Ther. 2011 19:2186-2200; herein incorporated by reference in its entirety).

In some embodiments, LNPs may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA may range from about 5: 1 to about 20: 1, from about 10: 1 to about 25: 1, from about 15: 1 to about 30: 1 and/or at least 30: 1.

The average molecular weight of the PEG moiety in the PEG-modified lipids can range from about 500 to about 8,000 Daltons (e.g., from about 1,000 to about 4,000 Daltons). In one preferred embodiment, the average molecular weight of the PEG moiety is about 2,000 Daltons.

The concentration of the aggregation reducing agent may range from about 0.1 to about 15 mol %, per 100% total moles of lipid in the LNP. In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2,5%, about 2%, about 1.5%, about 1%, about 0.5%, or about 0.3% on a molar basis (based on 100% total moles of lipids in the LNP).

Different LNPs having varying molar ratios of cationic lipid, non-cationic (or neutral) lipid, sterol (e.g., cholesterol), and aggregation reducing agent (such as a PEG-modified lipid) on a molar basis (based upon the total moles of lipid in the lipid nanoparticles) as depicted in Table 5 below:

TABLE 5

Lipid-based formulations

Molar Ratio of Lipids
(Based upon 100% total moles of lipid in the lipid nanoparticle)

| Formulation No. | Cationic Lipid | Non-Cationic (or Neutral) Lipid | Sterol | Aggregation Reducing Agent (e.g., PEG-lipid) |
|---|---|---|---|---|
| 1 | from about 35 to about 65% | from about 3 to about 12 or 15% | from about 15 to about 45% | from about 0.1 to about 10% (preferably from about 0.5 to about 2 or 3%) |
| 2 | from about 20 to about 70% | from about 5 to about 45% | from about 20 to about 55% | from about 0.1 to about 10% (preferably from about 0.5 to about 2 or 3%) |
| 3 | from about 45 to about 65% | from about 5 to about 10% | from about 25 to about 40% | from about 0.1 to about 3% |
| 4 | from about 20 to about 60% | from about 5 to about 25% | from about 25 to about 55% | from about 0.1 to about 5% (preferably from about 0.1 to about 3%) |
| 5 | about 40% | about 10% | about 40% | about 10% |
| 6 | about 35% | about 15% | about 40% | about 10% |
| 7 | about 52% | about 13% | about 30% | about 5% |
| 8 | about 50% | about 10% | about 38.5% | about 1.5% |

LNP Composition:

The composition of LNPs may be influenced by, inter alia, the selection of the cationic lipid component, the degree of cationic lipid saturation, the nature of the PEGylation, the ratio of all components and biophysical parameters such as In some embodiments, LNPs occur as liposeomes or lipoplexes as described in further detail below.

The total amount of nucleic acid, particularly the RNA in the lipid nanoparticles varies and may be defined depending on the e.g. RNA to total lipid w/w ratio. In one embodiment of the invention the RNA to total lipid ratio is less than 0.06 w/w, preferably between 0.03 w/w and 0.04 w/w.

LNP Size:

In some embodiments, LNPs have a median diameter size of from about 50 nm to about 300 nm, such as from about 50 nm to about 250 nm, for example, from about 50 nm to about 200 nm.

In some embodiments, smaller LNPs may be used. Such particles may comprise a diameter from below 0.1 μm up to 100 nm such as, but not limited to, less than 0.1 μm, less than 1 μm, less than 5 μm, less than 10 μm, less than 15 μm, less than 20 μm, less than 25 μm, less than 30 μm, less than 35 μm, less than 40 μm, less than 50 μm, less than 55 μm, less than 60 μm, less than 65 μm, less than 70 μm, less than 75 μm, less than 80 μm, less than 85 μm, less than 90 μm, less than 95 μm, less than 100 μm, less than 125 μm, less than 150 μm, less than 175 μm, less than 200 μm, less than 225 μm, less than 250 μm, less than 275 μm, less than 300 μm, less than 325 μm, less than 350 μm, less than 375 μm, less than 400 μm, less than 425 μm, less than 450 μm, less than 475 μm, less than 500 μm, less than 525 μm, less than 550 μm, less than 575 μm, less than 600 μm, less than 625 μm, less than 650 μm, less than 675 μm, less than 700 μm, less than 725 μm, less than 750 μm, less than 775 μm, less than 800 μm, less than 825 μm, less than 850 μm, less than 875 μm, less than 900 μm, less than 925 μm, less than 950 μm, less than 975 μm, In another embodiment, nucleic acids may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 nm to about 50 nm, from about 20 nm to about 50 nm, from about 30 nm to about 50 nm, from about 40 nm to about 50 nm, from about 20 nm to about 60 nm, from about 30 nm to about 60 nm, from about 40 nm to about 60 nm, from about 20 nm to about 70 nm, from about 30 nm to about 70 nm, from about 40 nm to about 70 nm, from about 50 nm to about 70 nm, from about 60 nm to about 70 nm, from about 20 nm to about 80 nm, from about 30 nm to about 80 nm, from about 40 nm to about 80 nm, from about 50 nm to about 80 nm, from about 60 nm to about 80 nm, from about 20 nm to about 90 nm, from about 30 nm to about 90 nm, from about 40 nm to about 90 nm, from about 50 nm to about 90 nm, from about 60 nm to about 90 nm and/or from about 70 nm to about 90 nm.

In some embodiments, the LNP may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In other embodiments, LNPs have a single mode particle size distribution (i.e., they are not bi- or poly-modal).

Other Components:

LNPs may further comprise one or more lipids and/or other components in addition to those mentioned above.

Other lipids may be included in the liposome compositions for a variety of purposes, such as to prevent lipid oxidation or to attach ligands onto the liposome surface. Any of a number of lipids may be present in LNPs, including amphipathic, neutral, cationic, and anionic lipids. Such lipids can be used alone or in combination.

Additional components that may be present in a LNP include bilayer stabilizing components such as polyamide oligomers (see, e.g., U.S. Pat. No. 6,320,017, which is incorporated by reference in its entirety), peptides, proteins, and detergents.

Liposomes:

In some embodiments, the inventive mRNAs, optionally comprised by (pharmaceutical) compositions or vaccines are formulated as liposomes.

Cationic lipid-based liposomes are able to complex with negatively charged nucleic acids (e.g. mRNAs) via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the nucleic acid is then released from the endosome/carrier into the cytoplasm. Uposomes have long been perceived as drug delivery vehicles because of their superior biocompatibility, given that liposomes are basically analogues of biological membranes, and can be prepared from both natural and synthetic phospholipids (Int J Nanomedicine. 2014; 9: 1833-1843).

Liposomes typically consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposomes may have one or more lipid membranes. Liposomes can be single-layered, referred to as unilamellar, or multi-layered, referred to as multilamellar.

Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec 1; 6:286).

Liposomes are typically present as spherical vesicles and can range in size from 20 nm to a few microns.

Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety. The inventive mRNA, optionally comprised by the (pharmaceutical) composition or vaccine, may be encapsulated by the liposome and/or it may be contained in an aqueous core which may then be encapsulated by the liposome (see International Pub. Nos. WO2012/031046, WO2012/031043, WO2012/030901 and WO2012/006378 and US Patent Publication No. US20130189351, US20130195969 and US20130202684; the contents of each of which are herein incorporated by reference in their entirety).

In some embodiments, the inventive mRNA, optionally comprised by the (pharmaceutical) composition or vaccine, may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

Lipoplexes:

In some embodiments, the inventive mRNA, optionally comprised by the (pharmaceutical) composition or vaccine, is formulated in the form of lipoplexes, i.e. cationic lipid bilayers sandwiched between nucleic acid (e.g. mRNA) layers.

Cationic lipids, such as DOTAP, (1,2-dioleoyl-3-trimethylammonium-propane) and DOTMA (N[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency.

Nanoliposomes

In some embodiments, the inventive mRNA, optionally comprised by the (pharmaceutical) composition or vaccine as defined herein, is formulated is the form of neutral lipid-based nanoliposomes such as 1,2-dioleoyl-sn-glycero-3-phosphatidylcholine (DOPC)-based nanoliposomes (Adv Drug Deliv Rev. 2014 February; 66: 110-116.).

Emulsions:

In some embodiments, the inventive mRNA, optionally comprised by the (pharmaceutical) composition or vaccine as defined herein, is provided in the form of an emulsion. In some embodiment, said mRNA is formulated in a cationic oil-in-water emulsion, wherein the emulsion particle comprises an oil core and a cationic lipid which can interact with said mRNA, anchoring the molecule to the emulsion particle (see International Pub. No. WO2012/006380; herein incorporated by reference in its entirety). In some embodiments, said mRNA is formulated in a water-in-oil emulsion comprising a continuous hydrophobic phase in which the hydrophilic phase is dispersed. As a non-limiting example, the emulsion may be made by the methods described in International Publication No. WO2010/87791, the contents of which are herein incorporated by reference in its entirety.

(Poly-)Cationic Compounds

According to preferred embodiments, the inventive mRNA, optionally comprised by the (pharmaceutical) composition or vaccine, is complexed or associated with a cationic or polycationic compound ("(poly-)cationic compound") and/or a polymeric carrier.

The term "(poly-)cationic compound" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4.

Accordingly, a "(poly-)cationic compound" may be any positively charged compound or polymer, preferably a cationic peptide or protein, which is positively charged under physiological conditions, particularly under physiological conditions in vivo. A "(poly-)cationic peptide or protein" may contain at least one positively charged amino acid, or more than one positively charged amino acid, e.g. selected from Arg, His, Lys or Orn. (Poly-)cationic amino acids, peptides and proteins (Poly-)cationic compounds being particularly preferred agents for complexation or association with the inventive mRNA, optionally comprised by the (pharmaceutical) composition or vaccine include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analogous peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, pIsl, FGF, Lactoferrin, Transportan, Buforin-2, Bac715-24, SynB, SynB(1), pVEC, hCT-derived peptides, SAP, or histones.

More preferably, the inventive mRNA, optionally comprised by the (pharmaceutical) composition or vaccine, is complexed with one or more polycations, preferably with protamine or oligofectamine (discussed below), most preferably with protamine. In this context protamine is particularly preferred.

Additionally, preferred (poly-)cationic proteins or peptides may be selected from the following proteins or peptides having the following total formula (III):

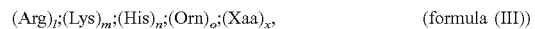

$(Arg)_l;(Lys)_m;(His)_n;(Orn)_o;(Xaa)_x,$ (formula (III))

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. $Arg_7$, $Arg_8$, $Arg_9$, $H_3R_9$, $R_9H_3$, $H_3R_9H_3$, $YSSR_9SSY$, $(RKH)_4$, $Y(RKH)_2R$, etc. In this context the disclosure of WO2009/030481 is incorporated herewith by reference.

Preferred cationic or polycationic proteins or peptides may be derived from formula Cys{(Arg)l;(Lys)m;(His)n;(Orn)o;(Xaa)x}Cys or {(Arg)l;(Lys)m;(His)n;(Orn)o;(Xaa)x} of the patent application WO2009/030481 or WO2011/026641, the disclosure of WO2009/030481 and WO2011/026641 relating thereto are incorporated herewith by reference. In a preferred embodiment, the cationic or polycationic proteins or peptides comprises CHHHHHHRRRRHHHHHHC (SEQ ID NO: 3450), CR12C (SEQ ID NO: 3447), CR12 (SEQ ID NO: 3448) or WR12C (SEQ ID NO: 3449).

(Poly-)Cationic Polysaccharides:

Further preferred (poly-)cationic compounds for complexation or association with the inventive mRNA, optionally comprised by the (pharmaceutical) composition or vaccine as defined herein, include (poly-)cationic polysaccharides, e.g. chitosan, polybrene, cationic polymers, e.g. polyethyleneimine (PEI).

(Poly-)Cationic Lipids: Further preferred (poly-)cationic compounds for complexation or association with the inventive mRNA, optionally comprised by the (pharmaceutical) composition or vaccine as defined herein, include (poly-)cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: 0,0-ditetradecanoyl-N-(α-trimethylammonioacetyl) diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or (poly-)cationic polymers, e.g. modified polyaminoacids, such as beta-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amido-amine)), etc., modified polybetaaminoester (PBAE), such as diamine end-modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

Polymeric Carriers:

According to further preferred embodiments, inventive mRNA, optionally comprised by the (pharmaceutical) composition or vaccine as defined herein, is complexed or associated with a polymeric carrier.

A "polymeric carrier" used according to the invention might be a polymeric carrier formed by disulfide-crosslinked cationic components. The disulfide-crosslinked cationic components may be the same or different from each other. The polymeric carrier can also contain further components.

It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO2012/013326 is incorporated herewith by reference.

In this context, the cationic components, which form basis for the polymeric carrier by disulfide-crosslinkage, are typically selected from any suitable (poly-)cationic peptide, protein or polymer suitable for this purpose, particular any (poly-)cationic peptide, protein or polymer capable of complexing, and thereby preferably condensing, the inventive mRNA, optionally comprised by the (pharmaceutical) composition or vaccine as defined herein. The (poly-)cationic peptide, protein or polymer, is preferably a linear molecule, however, branched (poly-)cationic peptides, proteins or polymers may also be used.

Every disulfide-crosslinking (poly-)cationic protein, peptide or polymer of the polymeric carrier, which may be used to complex the inventive mRNA, optionally comprised by the (pharmaceutical) composition or vaccine as defined herein, contains at least one -SH moiety, most preferably at least one cysteine residue or any further chemical group exhibiting an -SH moiety, capable of forming a disulfide linkage upon condensation with at least one further (poly-)cationic protein, peptide or polymer as cationic component of the polymeric carrier as mentioned herein.

As defined above, the polymeric carrier, which may be used to complex the inventive mRNA, optionally comprised by the (pharmaceutical) composition or vaccine as defined herein, may be formed by disulfide-crosslinked cationic (or polycationic) components. Preferably, such (poly-)cationic peptides or proteins or polymers of the polymeric carrier, which comprise or are additionally modified to comprise at least one -SH moiety, are selected from, proteins, peptides and polymers as defined herein.

In some embodiments, the polymeric carrier may be selected from a polymeric carrier molecule according to generic formula (IV):

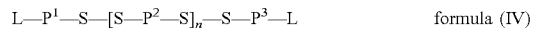

$$L-P^1-S-[S-P^2-S]_n-S-P^3-L \qquad \text{formula (IV)}$$

wherein, $P^1$ and $P^3$ are different or identical to each other and represent a linear or branched hydrophilic polymer chain, each $P^1$ and $P^3$ exhibiting at least one -SH-moiety, capable to form a disulfide linkage upon condensation with component $P^2$, or alternatively with (AA), $(AA)_x$, or $[(AA)_x]_2$ if such components are used as a linker between P1 and $P^2$ or $P^3$ and $P^2$) and/or with further components (e.g. (AA), (AA)x, ((AA)x]Z or L), the linear or branched hydrophilic polymer chain selected independent from each other from polyethylene glycol (PEG), poly-N-(2-hydroxypropyl) methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a (poly-)cationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a (poly-)cationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each P² exhibiting at least two -SH-moieties, capable to form a disulfide linkage upon condensation with further components P² or component(s) P¹ and/or P³ or alternatively with further components (e.g. (AA), (AA)x, or [(AA)x]z);

—S—S— is a (reversible) disulfide bond (the brackets are omitted for better readability), wherein S preferably represents sulphur or a -SH carrying moiety, which has formed a (reversible) disulfide bond. The (reversible) disulfide bond is preferably formed by condensation of -SH-moieties of either components P1 and P², P² and P², or P² and P³, or optionally of further components as defined herein (e.g. L, (AA), (AA), [(AA)]z, etc); The -SH-moiety may be part of the structure of these components or added by a modification as defined below; L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3 or 4 to 9, in a range of about 1, 2, 3, or 4 to 8, or in a range of about 1, 2, or 3 to 7.

In this context, the disclosure of WO2011/026641 is incorporated herewith by reference. Each of hydrophilic polymers P¹ and P³ typically exhibits at least one -SH-moiety, wherein the at least one -SH-moiety is capable to form a disulfide linkage upon reaction with component P² or with component (AA) or (AA)x, if used as linker between P¹ and P² or P³ and P² as defined below and optionally with a further component, e.g. L and/or (AA) or (AA)$_x$, e.g. if two or more -SH-moieties are contained. The following subformulae "P¹-S—S—P²" and "P²—S—S—P³" within generic formula (IV) above (the brackets are omitted for better readability), wherein any of S, P¹ and P³ are as defined herein, typically represent a situation, wherein one-SH-moiety of hydrophilic polymers P¹ and P³ was condensed with one -SH-moiety of component P² of generic formula (IV) above, wherein both sulphurs of these -SH-moieties form a disulfide bond—S—S— as defined herein in formula (IV). These -SH-moieties are typically provided by each of the hydrophilic polymers P1 and P³, e.g. via an internal cysteine or any further (modified) amino acid or compound which carries a -SH moiety. Accordingly, the subformulae "P¹-S—S—P²" and "P²—S—S—P³" may also be written as "P¹-Cys-Cys-P²" and "P²-Cys-Cys-P³", if the -SH- moiety is provided by a cysteine, wherein the term "Cys-Cys" represents two cysteines coupled via a disulfide bond, not via a peptide bond. In this case, the term "—S—S-" in these formulae may also be written as "—S-Cys", as "-Cys-S" or as "-Cys-Cys-". In this context, the term "-Cys-Cys-" does not represent a peptide bond but a linkage of two cysteines via their -SH-moieties to form a disulfide bond. Accordingly, the term "-Cys-Cys-" also may be understood generally as "-(Cys-S)-(S-Cys)-", wherein in this specific case S indicates the sulphur of the -SH-moiety of cysteine. Likewise, the terms "—S-Cys" and "—Cys-S" indicate a disulfide bond between a -SH containing moiety and a cysteine, which may also be written as "—S-(S-Cys)" and "-(Cys-S)—S". Alternatively, the hydrophilic polymers P¹ and P³ may be modified with a -SH moiety, preferably via a chemical reaction with a compound carrying a -SH moiety, such that each of the hydrophilic polymers P¹ and P³ carries at least one such -SH moiety. Such a compound carrying a -SH moiety may be e.g. an (additional) cysteine or any further (modified) amino acid, which carries a -SH moiety. Such a compound may also be any non-amino compound or moiety, which contains or allows to introduce a -SH moiety into hydrophilic polymers P1 and P³ as defined herein. Such non-amino compounds may be attached to the hydrophilic polymers P¹ and P³ of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsaturated carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g. halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers P¹ and P³. As defined herein, each of hydrophilic polymers P¹ and P³ typically exhibits at least one -SH-moiety preferably at one terminal end, but may also contain two or even more -SH-moieties, which may be used to additionally attach further components as defined herein, preferably further functional peptides or proteins e.g. a ligand, an amino acid component (AA) or (AA)x, antibodies, cell penetrating peptides or enhancer peptides (e.g. TAT, KALA), etc.

In a particularly preferred embodiment, the polymeric carrier is a peptide polymer, preferably a polyethylene glycol/peptide polymer comprising HO-PEG5000—S—(S—CHHHHHHRRRRHHHHHHC-S-)7—S-PEG5000—OH (peptide component: SEQ ID NO: 3450) and a lipid component, preferably a lipidoid component, more preferably lipidoid 3-C12—OH.

The Lipidoid 3-C12—OH

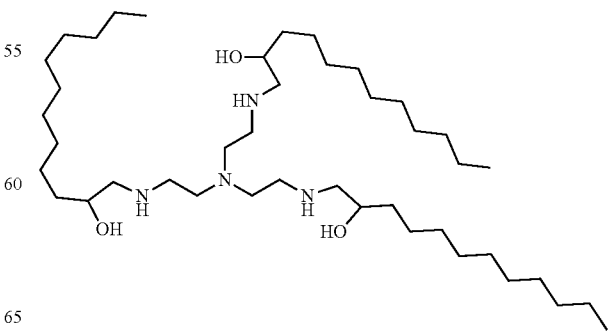

(as shown above) may be obtained by acylation of tris(2-aminoethyl)amine with an activated lauric (C12) acid derivative, followed by reduction of the amide. Alternatively, it may be prepared by reductive amination with the corresponding aldehyde. Lipidoid 3—C12—OH is prepared by addition of the terminal C12 alkyl epoxide with the same oligoamine according to Love et al., pp. 1864-1869, PNAS, vol. 107 (2010), no. 5 (cf. compound C12 and compound 110 in FIG. 1 of Love et al.). In preferred embodiments, the peptide polymer comprising lipidoid 3—C12—OH as specified above is used to complex the artificial nucleic acid of the invention, in particular RNA, to form complexes having an N/P ratio from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the artificial nucleic acid.

In another embodiment, the polymeric carrier comprises a lipidoid compound according to formula Va

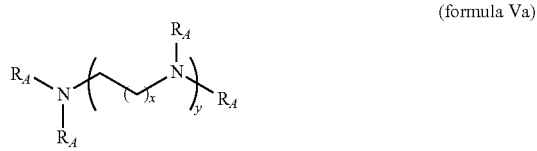

(formula Va)

wherein $R_A$ is independently selected for each occurrence an unsubstituted, cyclic or acyclic, branched or unbranched C1-20 aliphatic group; a substituted or unsubstituted, cyclic or acyclic, branched or unbranched C1-20 heteroaliphatic group; a substituted or unsubstituted aryl; a substituted or unsubstituted heteroaryl;

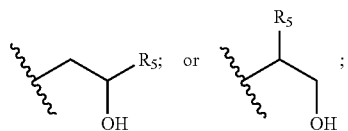

wherein at least one $R_A$ is

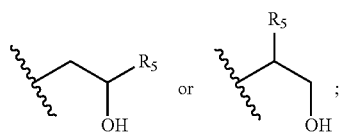

$R_5$ is independently selected for each occurrence of from an unsubstituted, cyclic or acyclic, branched or unbranched C8-16 aliphatic; a substituted or unsubstituted aryl; or a substituted or unsubstituted heteroaryl;

each occurrence of x is an integer from 1 to 10;

each occurrence of γ is an integer from 1 to 10; or a pharmaceutically acceptable salt thereof.

In that context, the disclosure of the PCT patent application PCT/EP2017/064059 is herewith incorporated by reference.

In other embodiments, the composition, which is preferably a (pharmaceutical) composition comprises at least one artificial nucleic acid as described herein, wherein the at least one artificial nucleic acid is complexed or associated with polymeric carriers and, optionally, with at least one lipid component as described in the PCT applications PCT/EP2017/064065, PCT/EP2017/064058. In this context, the disclosures of PCT/EP2017/064065, and PCT/EP2017/064058 is herewith incorporated by reference.

Weight Ratio and N/P Ratio

In preferred embodiments of the invention, the inventive mRNA is associated with or complexed with a (poly-)cationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of said RNA to (poly-)cationic compound and/or polymeric carrier; or optionally in a nitrogen/phosphate (N/P) ratio of said RNA to (poly-)cationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one said RNA to the one or more polycations is in the range of about 0.1 to 10, including a range of about 0.3 to 4, of about 0.5 to 2, of about 0.7 to 2 and of about 0.7 to 1.5.

The mRNA, optionally comprised by the (pharmaceutical) composition or vaccine, can also be associated with a vehicle, transfection or complexation agent for increasing the transfection efficiency and/or the immunostimulatory properties of said mRNA.

The (pharmaceutical) composition or vaccine may comprise at least one mRNA which is complexed with one or more (poly-)cationic compounds and/or polymeric carriers as defined above, and at least one "free" mRNA, wherein the at least one complexed RNA is preferably identical to the at least one "free" RNA.

In this context, it is particularly preferred that the inventive (pharmaceutical) composition or vaccine comprises the mRNA that is complexed at least partially with a (poly-)cationic compound and/or a polymeric carrier, preferably cationic proteins or peptides. In this context, the disclosure of WO2010/037539 and WO2012/113513 is incorporated herewith by reference. "Partially" means that only a part of said mRNA is complexed with a (poly-)cationic compound and/or polymeric carrier, while the rest of said mRNA is present in uncomplexed form ("free").

Preferably, the molar ratio of the complexed mRNA to the free mRNA is selected from a molar ratio of about 0.001:1 to about 1:0.001, including a ratio of about 1:1. More preferably the ratio of complexed mRNA to free mRNA is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed mRNA to free mRNA is selected from a ratio of about 1:1 (w/w).

The complexed mRNA, optionally comprised by the (pharmaceutical) composition or vaccine as defined herein, is preferably prepared according to a first step by complexing said mRNA with a (poly-)cationic compound and/or with a polymeric carrier, preferably as defined herein, in a specific ratio to form a stable complex. In this context, it is highly preferable, that no free (poly-)cationic compound or polymeric carrier or only a negligibly small amount thereof remains in the fraction of the complexed mRNA after complexing said mRNA. Accordingly, the ratio of the mRNA and the (poly-)cationic compound and/or the polymeric carrier in the fraction of the complexed RNA is typically selected in a range so that the mRNA is entirely complexed and no free (poly-)cationic compound or polymeric carrier or only a negligibly small amount thereof remains in said fraction.

Preferably, the ratio of said mRNA as defined herein to the (poly-)cationic compound and/or the polymeric carrier, preferably as defined herein, is selected from a range of about 6:1 (w/w) to about 0,25:1 (w/w), more preferably from about 5:1 (w/w) to about 0,5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

Alternatively, the ratio of said mRNA to the (poly-)cationic compound and/or the polymeric carrier may also be calculated on the basis of the nitrogen/phosphate ratio (N/P-ratio) of the entire complex. In the context of the present invention, an N/P-ratio is preferably in the range of about 0.1-10, preferably in a range of about 0.3-4 and most preferably in a range of about 0.5-2 or 0.7-2 regarding the ratio of mRNA: (poly-)cationic compound and/or polymeric carrier, preferably as defined herein, in the complex, and most preferably in a range of about 0.7-1,5, 0.5-1 or 0.7-1, and even most preferably in a range of about 0.3-0.9 or 0.5-0.9, preferably provided that the (poly-)cationic compound in the complex is a (poly-)cationic protein or peptide and/or the polymeric carrier as defined above.

In other embodiments, the inventive mRNA, optionally comprised by the (pharmaceutical) composition or vaccine as defined herein, may be used in free or naked form without being associated with any further vehicle, transfection or complexation agent.

It has to be understood and recognized, that according to the present invention, the (pharmaceutical) composition or vaccine as defined herein may comprise at least one free mRNA as defined herein, and/or at least one complexed mRNA as defined herein, wherein every agent disclosed herein may be used for complexation.

Adjuvants

According to further embodiments, the (pharmaceutical) composition or vaccine of the invention comprises an adjuvant, which is preferably added in order to enhance the immunostimulatory properties of said (pharmaceutical) composition or vaccine.

An adjuvant or an adjuvant component in the broadest sense is typically a pharmacological and/or immunological agent that may modify, e.g. enhance, the effect of other agents, e.g. therapeutic agents or vaccines. In this context, an adjuvant may be understood as any compound, which is suitable to support administration and delivery of the composition according to the invention.

Furthermore, such an adjuvant may, without being bound thereto, initiate or increase an immune response of the innate immune system, i.e. a non-specific immune response. "Adjuvants" typically do not elicit an adaptive immune response. Insofar, "adjuvants" do not qualify as antigens. In other words, when administered, the inventive (pharmaceutical) composition or vaccine typically initiates an adaptive immune response due to an antigenic peptide or protein, which is encoded by the at least one coding sequence of the mRNA contained in said (pharmaceutical) composition or vaccine. Additionally, an adjuvant present in the (pharmaceutical) composition or vaccine according to the invention may generate an (supportive) innate immune response.

Such an adjuvant may be selected from any adjuvant known to a skilled person and suitable for the present case, i.e. supporting the induction of an immune response in a mammal. Preferably, the adjuvant may be selected from the group consisting of, without being limited thereto, TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl-dodecanoyl-amide hydroacetate); CALCITRIOL™ (1-alpha, 25-dihydroxy-vitamin D3); calcium phosphate gel; CAP™ (calcium phosphate nanoparticles); cholera holotoxin, cholera-toxin-Al-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i)N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(bl-4)-N-acetylmuramyl-L-alanyl-D-isoglutamine); imiquimod (1-(2-methypropyl)-1H-imidazo[4,5-c]quinoline-4-amine); ImmTher™ (N-acetylglucosaminyl-N-acetylmuramyl-L-Ala-D-isoGlu-L-Ala-glycerol dipalmitate); DRVs (immunoliposomes prepared from dehydration-rehydration vesicles); interferon-gamma; interleukin-ibeta; interleukin-2; interleukin-7; interleukin-12; ISCOMS™; ISCOPREP 7.03™; liposomes; LOXORIBINE™ (7-allyl-8-oxoguanosine); LT oral adjuvant (E. coli labile enterotoxin-protoxin); microspheres and microparticles of any composition; MF59™; (squalene-water emulsion); MONTANIDE ISA 51™ (purified incomplete Freund's adjuvant); MONTANIDE ISA 720™ (metabolisable oil adjuvant); MPL™ (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDErM (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (β-glucan); PLGA, PGA and PLA (homo- and co-polymers of lactic acid and glycolic acid; microspheres/nanospheres); PLURONIC L121™; PMMA (polymethyl methacrylate); PODDS⁷M (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULON™ (QS-21); Quil-A (Quil-A saponin); S-28463 (4-amino-otec-dimethyl-2-ethoxymethyl-1H-imidazo[4,5 c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethyltetracosan and 2,6,10,15,19,23-hexamethyl-2,6,10,14,18,22-tetracosahexane); stearyltyrosine (octadecyltyrosine hydrochloride); Theramid® (N-acetylglucosaminyl-N- acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Particularly preferred, an adjuvant may be selected from adjuvants, which support induction of a Th1-immune response or maturation of naïve T-cells, such as GM-CSF, IL-12, IFNγ, any immunostimulatory nucleic acid as defined above, preferably an immunostimulatory RNA, CpG DNA, etc.

(Poly-)Cationic Compounds:

Suitable adjuvants may also be selected from (poly-)cationic compounds as described herein for complexation of the inventive mRNA. Associating or complexing the inventive mRNA comprised by the (pharmaceutical) composition or vaccine with (poly-)cationic compounds as defined herein preferably provides adjuvant properties and confers a stabilizing effect to the said mRNA.

In particular, preferred (poly-)cationic compounds are selected from (poly-)cationic peptides or proteins, including protamine, nucleoline, spermin or spermidine, or other cationic peptides or proteins, such as poly-L-lysine (PLL), poly-arginine, basic polypeptides, cell penetrating peptides (CPPs), including HIV-binding peptides, Tat, HIV-1 Tat (HIV), Tat-derived peptides, Penetratin, VP22 derived or analog peptides, HSV VP22 (Herpes simplex), MAP, KALA or protein transduction domains (PTDs, PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, pIsl, FGF, Lactoferrin, Transportan, Buforin-2, Bac715-24, SynB, SynB(1), pVEC, hCT-derived peptides, SAP, protamine, spermine, spermidine, or histones. Further preferred (poly-)cationic compounds may include cationic polysaccharides, for example chitosan, polybrene, cationic polymers, e.g. polyethyleneimine (PEI), cationic lipids, e.g. DOTMA: [1-(2,3-sioleyloxy)propyl])-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: 0,0-ditetradecanoyl-N-(α-trimethylammonioacetyl) diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl)-trimethylammonium, CLIP9: rac-[2(2,3-dihexadecyloxypropyl-oxysuccinyloxy)ethyl]-trimethylammonium, oligofectamine, or (poly-)cationic polymers, e.g. modified polyaminoacids, such as 5-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified Amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, Chitosan, etc., silan backbone based polymers, such as PMOXA-PDMS copolymers, etc., blockpolymers consisting of a combination of one or more cationic blocks (e.g. selected of a cationic polymer as mentioned above) and of one or more hydrophilic- or hydrophobic blocks (e.g. polyethyleneglycole); etc.

Additionally, preferred (poly-)cationic proteins or peptides, which can be used as an adjuvant by complexing the inventive mRNA comprised by the (pharmaceutical) composition or vaccine according to the invention, may be selected from following proteins or peptides having the following total formula (III):

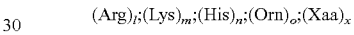

$(Arg)_l;(Lys)_m;(His)_n;(Orn)_o;(Xaa)_x$ wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred oligoarginines in this context are e.g. $Arg_7$, $Arg_8$, $Arg_9$, $Arg_7$, $H_3R_9$, $R_9H_3$, $H_3R_9H_3$, $YSSR_9SSY$, $(RKH)_4$, $Y(RKH)_2R$, etc.

The ratio of the inventive mRNA to the (poly-)cationic compound in the adjuvant component may be calculated on the basis of the nitrogen/phosphate ratio (N/P-ratio) of the entire complex, i.e. the ratio of positively charged (nitrogen) atoms of the (poly-)cationic compound to the negatively charged phosphate atoms of said mRNA. For example, 1 μg of mRNA typically contains about 3 nmol phosphate residues, provided said RNA exhibits a statistical distribution of bases. Additionally, 1 μg of peptide typically contains about x nmol nitrogen residues, dependent on the molecular weight and the number of basic amino acids. When exemplarily calculated for (Arg)9 (molecular weight 1424 g/mol, 9 nitrogen atoms), 1 μg (Arg)9 contains about 700 pmol (Arg)$_9$ and thus 700×9=6300 pmol basic amino acids=6.3 nmol nitrogen atoms. For a mass ratio of about 1:1 RNA/(Arg)9 an N/P ratio of about 2 can be calculated. When exemplarily calculated for protamine (molecular weight about 4250 g/mol, 21 nitrogen atoms, when protamine from salmon is used) with a mass ratio of about 2:1 with 2 μg RNA, 6 nmol phosphate are to be calculated for the RNA; 1 μg protamine contains about 235 pmol protamine molecules and thus 235×21=4935 pmol basic nitrogen atoms=4.9 nmol nitrogen atoms. For a mass ratio of about 2:1 RNA/protamine an N/P ratio of about 0.81 can be calculated. For a mass ratio of about 8:1 RNA/protamine an N/P ratio of about 0.2 can be calculated. In the context of the present invention, an N/P-ratio is preferably in the range of about 0.1-10, preferably in a range of about 0.3-4 and most preferably in a range of about 0.5-2 or 0.7-2 regarding the ratio of RNA:peptide in the complex, and most preferably in the range of about 0.7-1.5.

Preparation:

In preferred embodiments, the (pharmaceutical) composition or vaccine of the present invention is obtained in two separate steps in order to obtain both, an efficient immunostimulatory effect and efficient translation of the mRNA comprised by said (pharmaceutical) composition or vaccine.

In a first step, an mRNA according to the invention is complexed with a (poly-)cationic compound in a specific ratio to form a stable complex ("complexed (RNA"). In this context, it is important, that no free (poly-)cationic compound or only a neglibly small amount remains in the fraction of the complexed RNA. Accordingly, the ratio of the mRNA and the (poly-)cationic compound is typically selected in a range that the mRNA is entirely complexed and no free (poly-)cationic compound or only a neglectably small amount remains in the fraction of said complexed mRNA. Preferably the ratio of the mRNA to the (poly-)cationic compound is selected from a range of about 6:1 (w/w) to about 0,25:1 (w/w), more preferably from about 5:1 (w/w) to about 0,5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

According to preferred embodiments, in a second step, an mRNA is added to the fraction of the complexed mRNA in order to form the (immunostimulatory) composition of the invention. Therein, said added mRNA is present as free RNA, preferably as free mRNA, which is not complexed by other compounds. Prior to addition, the free RNA is not complexed and will preferably not undergo any detectable or significant complexation reaction upon the addition to the complexed mRNA. This is due to the strong binding of the (poly-)cationic compound to the complexed mRNA. In other words, when the free mRNA is added to the complexed mRNA, preferably no free or substantially no free (poly-)cationic compound is present, which could form a complex with said free mRNA. Accordingly, the free mRNA of the inventive (pharmaceutical) composition or vaccine can efficiently be transcribed in vivo. Therein, the free mRNA, may occur as a mono-, di-, or multicistronic (m)RNA, i.e. an mRNA which carries the coding sequences of one or more antigenic peptides or proteins. Such coding sequences in di-, or even multicistronic mRNA may be separated by at least one IRES sequence, e.g. as defined herein.

In particularly preferred embodiments, the free mRNA comprised by the inventive (pharmaceutical) composition or vaccine, may be identical or different to the complexed mRNA, depending on the specific requirements of therapy. Even more preferably, the free mRNA, which is comprised by the inventive (pharmaceutical) composition or vaccine, is identical to the complexed mRNA, in other words, the (pharmaceutical) composition or vaccine comprises the mRNA in both free and complexed form.

In particularly preferred embodiments, the inventive (pharmaceutical) composition or vaccine thus comprises the mRNA as defined herein, wherein said mRNA is present in the said (pharmaceutical) composition or vaccine partially as free RNA and partially as complexed RNA. Preferably, the mRNA as defined herein, preferably an mRNA, is complexed as described above and the same mRNA is then added in the form of free RNA, wherein preferably the compound, which is used for complexing the mRNA is not present in free form at the moment of addition of the free mRNA.

The ratio of the complexed mRNA and the free mRNA may be selected depending on the specific requirements of a particular therapy. Typically, the ratio of the complexed mRNA and the free mRNA is selected such that a significant stimulation of the innate immune system is elicited due to the presence of the complexed mRNA. In parallel, the ratio is selected such that a significant amount of the free mRNA can be provided in vivo leading to an efficient translation and concentration of the expressed antigenic peptide or protein in vivo. Preferably the ratio of the complexed mRNA to free mRNA in the inventive (pharmaceutical) composition or vaccine is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably about 1:1 (w/w).

Additionally or alternatively, the ratio of the complexed mRNA and the free mRNA may be calculated on the basis of the nitrogen/phosphate ratio (N/P-ratio) of the entire RNA complex. In the context of the present invention, an N/P-ratio is preferably in the range of about 0.1-10, preferably in a range of about 0.3-4 and most preferably in a range of about 0.5-2 or 0.7-2 regarding the ratio of RNA: peptide in the complex, and most preferably in the range of about 0.7-1.5.

Additionally or alternatively, the ratio of the complexed mRNA and the free mRNA may also be selected on the basis of the molar ratio of both RNAs to each other. Typically, the molar ratio of the complexed mRNA to the free mRNA may be selected such, that the molar ratio suffices the above (w/w) and/or N/P-definitions. More preferably, the molar ratio of the complexed mRNA to the free mRNA may be selected e.g. from a molar ratio of about 0.001:1, 0.01:1, 0.1:1, 0.2:1, 0.3:1, 0.4:1, 0.5:1, 0.6:1, 0.7:1, 0.8:1, 0.9:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.001:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.9 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.9:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, or a range of about 0.01:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, etc.

Even more preferably, the molar ratio of the complexed mRNA to the free mRNA may be selected e.g. from a range of about 0.01:1 to 1:0.01. Most preferably, the molar ratio of the complexed mRNA to the free mRNA may be selected e.g. from a molar ratio of about 1:1. Any of the above definitions with regard to (w/w) and/or N/P ratio may also apply.

Adjuvant Nucleic Acids:

Suitable adjuvants may furthermore be selected from nucleic acids having the formula (Va):

$$G_l X_m G_n$$

wherein:
G is guanosine, uracil or an analogue of guanosine or uracil;
X is guanosine, uracil, adenosine, thymidine, cytosine or an analogue of the above-mentioned nucleotides;
l is an integer from 1 to 40, wherein when l=1 G is guanosine or an analogue thereof, when l>1 at least 50% of the nucleotides are guanosine or an analogue thereof;
m is an integer and is at least 3; wherein when m=3 X is uracil or an analogue thereof, when m>3 at least 3 successive uracils or analogues of uracil occur;
n is an integer from 1 to 40, wherein when n=1 G is guanosine or an analogue thereof, when n >1 at least 50% of the nucleotides are guanosine or an analogue thereof, or formula (Vb):

$$(N_u G_l X_m G_n N_v)_a,$$

wherein:
G is guanosine (guanine), uridine (uracil) or an analogue of guanosine (guanine) or uridine (uracil), preferably guanosine (guanine) or an analogue thereof;
X is guanosine (guanine), uridine (uracil), adenosine (adenine), thymidine (thymine), cytidine (cytosine), or an analogue of these nucleotides (nucleosides), preferably uridine (uracil) or an analogue thereof;
N is a nucleic acid sequence having a length of about 4 to 50, preferably of about 4 to 40, more preferably of about 4 to 30 or 4 to 20 nucleic acids, each N independently being selected from guanosine (guanine), uridine (uracil), adenosine (adenine), thymidine (thymine), cytidine (cytosine) or an analogue of these nucleotides (nucleosides);
a is an integer from 1 to 20, preferably from 1 to 15, most preferably from 1 to 10;
l is an integer from 1 to 40, wherein when l=1, G is guanosine (guanine) or an analogue thereof, when l>1, at least 50% of these nucleotides (nucleosides) are guanosine (guanine) or an analogue thereof;
m is an integer and is at least 3; wherein when m=3, X is uridine (uracil) or an analogue thereof, and when m >3, at least 3 successive uridines (uracils) or analogues of uridine (uracil) occur;
n is an integer from 1 to 40, wherein when n=1, G is guanosine (guanine) or an analogue thereof, when n>1, at least 50% of these nucleotides (nucleosides) are guanosine (guanine) or an analogue thereof;
u,v may be independently from each other an integer from 0 to 50, preferably wherein when u=0, v≥1, or when u=0, u≥1; wherein the nucleic acid molecule of formula (Vb) has a length of at least 50 nucleotides, preferably of at least 100 nucleotides, more preferably of at least 150 nucleotides, even more preferably of at least 200 nucleotides and most preferably of at least 250 nucleotides.

Other suitable adjuvants may furthermore be selected from nucleic acids having the formula (VI):

$$C_l X_m C_n$$

wherein:
C is cytosine, uracil or an analogue of cytosine or uracil;
X is guanosine, uracil, adenosine, thymidine, cytosine or an analogue of the above-mentioned nucleotides;
l is an integer from 1 to 40, wherein when l=1 C is cytosine or an analogue thereof, when l>1 at least 50% of the nucleotides are cytosine or an analogue thereof;
m is an integer and is at least 3; wherein when m=3 X is uracil or an analogue thereof, when m >3 at least 3 successive uracils or analogues of uracil occur;
n is an integer from 1 to 40, wherein when n=1 C is cytosine or an analogue thereof, when n >1 at least 50% of the nucleotides are cytosine or an analogue thereof.

In this context the disclosure of WO2008/014979 and WO2009/095226 is also incorporated herein by reference.

Further Agents

In further preferred embodiments it is also possible that the inventive (pharmaceutical) composition or vaccine contains, in addition to the inventive mRNA, further agents or components optionally selected from the group comprising: further antigens (e.g. in the form of a peptide or protein) or further nucleic acids encoding an antigenic peptide or protein; further immunotherapeutic agents; further auxiliary substances; or any further compound, which is known to be immunostimulating due to its binding affinity (as ligands) to human Toll-like receptors; and/or an adjuvant nucleic acid, preferably an immunostimulatory RNA (isRNA).

Auxiliary Substances:

The inventive (pharmaceutical) composition or vaccine may thus additionally contain one or more auxiliary substances in order to increase its immunogenicity or immunostimulatory capacity, if desired. Such auxiliary substances preferably act together with the inventive mRNA in a synergistic manner.

In general, it is possible to use as auxiliary substance any agent that influences the immune system in the manner of a "danger signal" (LPS, GP96, etc.) or cytokines, such as GM-CFS, which allow an immune response to be enhanced and/or influenced in a targeted manner. Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta or TNF-alpha, growth factors, such as hGH.

The inventive (pharmaceutical) composition or vaccine may also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive (pharmaceutical) composition or vaccine may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)).

According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

Another class of compounds, which may be added to an inventive (pharmaceutical) composition or vaccine may be immunostimulatory RNAs, i.e. RNAs that are able to induce an innate immune response. isRNAs usually do not comprise open reading frame and thus does not provide an epitope or antigen or immunogen but elicit an immune response e.g. by binding to a specific kind of Toll-like-receptor (TLR) or other suitable receptors. However, of course also (m)RNAs having an open reading frame and coding for a peptide/protein may induce an innate immune response and, thus, may be immunostimulatory RNAs.

Pharmaceutically Acceptable Carriers and Excipients

Preferably, the (pharmaceutical) composition or vaccine according to the invention comprises at least one pharmaceutically acceptable excipient, in particular at least one pharmaceutically acceptable carrier. The term "pharmaceutically acceptable" refers to a compound or agent that is compatible with the one or more active agent(s) (here: the inventive mRNA) and does not interfere with and/or substantially reduce their pharmaceutical activities. Pharmaceutically acceptable carriers preferably have sufficiently high purity and sufficiently low toxicity to make them suitable for administration to a subject to be treated.

Pharmaceutically acceptable excipients can exhibit different functional roles and include, without limitation, diluents, fillers, bulking agents, carriers, disintegrants, binders, lubricants, glidants, coatings, solvents and co-solvents, buffering agents, preservatives, adjuvants, anti-oxidants, wetting agents, anti-foaming agents, thickening agents, sweetening agents, flavouring agents and humectants.

For (pharmaceutical) compositions or vaccines in liquid form, useful pharmaceutically acceptable excipients in general include solvents, diluents or carriers such as (pyrogen-free) water, (isotonic) saline solutions such phosphate or citrate buffered saline, fixed oils, vegetable oils, such as, for example, groundnut oil, cottonseed oil, sesame oil, olive oil, corn oil, ethanol, polyols (for example, glycerol, propylene glycol, polyetheylene glycol, and the like); lecithin; surfactants; preservatives such as benzyl alcohol, parabens, chlorobutanol, phenol, ascorbic acid, thimerosal, and the like; isotonic agents such as sugars, polyalcohols such as manitol, sorbitol, or sodium chloride; aluminum monostearate or gelatin; antioxidants such as ascorbic acid or sodium bisulfite; chelating agents such as ethylenediaminetetraacetic acid (EDTA); buffers such as acetates, citrates or phosphates and agents for the adjustment of tonicity such as sodium chloride or dextrose. pH can be adjusted with acids or bases, such as hydrochloric acid or sodium hydroxide. Buffers may be hypertonic, isotonic or hypotonic with reference to the specific reference medium, i.e. the buffer may have a higher, identical or lower salt content with reference to the specific reference medium, wherein preferably such concentrations of the aforementioned salts may be used, which do not lead to damage of cells due to osmosis or other concentration effects. Reference media are e.g. liquids occurring in "in vivo" methods, such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

Carriers

Suitable pharmaceutically acceptable carriers are typically chosen based on the formulation of the (pharmaceutical) composition or vaccine.

Liquid (pharmaceutical) compositions or vaccines administered via injection and in particular via i.v. injection should be sterile and stable under the conditions of manufacture and storage. Such compositions are typically formulated as parenterally acceptable aqueous solutions that are pyrogen-free, have suitable pH, are isotonic and maintain stability of the active ingredient(s).

Particularly useful pharmaceutically acceptable carriers for liquid (pharmaceutical) compositions or vaccines according to the invention include water, typically pyrogen-free water; isotonic saline or buffered (aqueous) solutions, e.g phosphate, citrate etc. buffered solutions. Particularly for injection of the inventive (pharmaceutical) compositions or vaccines, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt.

According to preferred embodiments, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer.

According to more preferred embodiments, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

For (pharmaceutical) compositions in (semi-)solid form, useful pharmaceutically acceptable excipients include binders such as microcrystalline cellulose, gum tragacanth or gelatin; starch or lactose; sugars, such as, for example, lactose, glucose and sucrose; starches, such as, for example, corn starch or potato starch; cellulose and its derivatives, such as, for example, sodium carboxymethylcellulose, ethylcellulose, cellulose acetate; disintegrants such as alginic acid; lubricants such as magnesium stearate; glidants such as stearic acid, magnesium stearate; calcium sulphate, colloidal silicon dioxide and the like; sweetening agents such as sucrose or saccharin; and/or flavouring agents such as peppermint, methyl salicylate, or orange flavouring.

Formulation (Pharmaceutical) compositions for topical administration can be formulated as creams, ointments, gels, pastes or powders. (Pharmaceutical) compositions for oral administration can be formulated as tablets, capsules, liquids, powders or in a sustained release format.

According to preferred embodiments, the inventive mRNA, (pharmaceutical) composition or vaccine is administered parenterally, in particular via intradermal or intramuscular injection. Accordingly, mRNAs, (pharmaceutical) compositions or vaccines of the invention are preferably formulated for parenteral administration (in particular injection) and are thus typically provided in liquid form (e.g. lipid based or saline based) or lyophilized form. Parenteral formulations are typically stored in vials, IV bags, ampoules, cartridges, or prefilled syringes and can be administered as injections, inhalants, or aerosols, with injections being preferred. Preferred parenteral formulations for injection include sterile solutions of water, physiological saline or mixtures thereof, with a physiological pH of about 7.4

Lyophilized Formulations:

In preferred embodiments, the mRNA, (pharmaceutical) composition or vaccine of the invention is provided in lyophilized form. Preferably, the lyophilized mRNA, (pharmaceutical) composition or vaccine is reconstituted in a suitable buffer, advantageously based on an aqueous carrier, prior to administration, e.g. Ringer-Lactate solution, which is preferred, Ringer solution, a phosphate buffer solution. In some embodiments, the (pharmaceutical) composition or vaccine according to the invention contains at least two, three, four, five, six or more mRNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of said mRNAs.

Liquid Formulations:

In further preferred embodiments, the mRNA, (pharmaceutical) composition or vaccine is provided in the form of a saline or a lipid-based formulation. Lipid-based formulations may be selected from, but not limited to, liposomes, lipoplexes, nanoliposomes and lipid nanoparticles which are described above in the section headed "Complexation".

Dose

The (pharmaceutical) composition or vaccine typically comprises a safe and effective amount the inventive mRNA.

As used herein, "safe and effective amount" means an amount of the active agent(s) that is sufficient to significantly induce a positive modification of the disease to be treated. At the same time, however, a "safe and effective amount" is small enough to avoid serious side-effects, that is to say to permit a sensible relationship between advantage and risk.

In the context of the present invention, the expression "safe and effective amount" preferably means an amount of the active agent(s) that is suitable for stimulating the adaptive immune system in such a manner that no excessive or damaging immune reactions are achieved but, preferably, also no such immune reactions below a measurable level.

A "safe and effective amount" of any of the active agent(s) will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor.

Specifically, a "safe and effective amount" of the inventive mRNA may furthermore be selected depending on the type of mRNA, e.g. monocistronic, bi- or even multicistronic RNA, since a bi- or even multicistronic RNA may lead to a significantly higher expression of the encoded antigen(s) than the use of an equal amount of a monocistronic RNA.

Kit

In a further aspect, the present invention relates to a kit or kit-of-parts comprising as its components the mRNA, (pharmaceutical) composition or vaccine according to the invention, and optionally technical instructions with information on the administration and dosage of said components.

Optionally, the kit-of-parts may comprise at least one further agent as defined herein in the context of the pharmaceutical composition, antimicrobial agents, RNase inhibitors, solubilizing agents or the like.

The kit-of-parts may be a kit of two or more parts and typically comprises the components in suitable containers. For example, each container may be in the form of vials, bottles, squeeze bottles, jars, sealed sleeves, envelopes or pouches, tubes or blister packages or any other suitable form provided the container is configured so as to prevent premature mixing of components. Each of the different components may be provided separately, or some of the different components may be provided together (i.e. in the same container). A container may also be a compartment or a chamber within a vial, a tube, a jar, or an envelope, or a sleeve, or a blister package or a bottle, provided that the contents of one compartment are not able to associate physically with the contents of another compartment prior to their deliberate mixing by a pharmacist or physician.

Medical Use and Treatment

The inventive mRNA, the (pharmaceutical composition), vaccine or kit-of-parts defined herein may be used for human and also for veterinary medical purposes, preferably for human medical purposes.

According to a further aspect, the invention thus relates to the inventive mRNA, (pharmaceutical composition), vaccine or kit-of-parts for use as a medicament. The inventive mRNA, (pharmaceutical composition), vaccine or kit-of-parts are particularly useful for treatment and/or prophylaxis of diseases of lassa infections or disorders related thereto.

The term "treatment" or "treating" of a disease includes preventing or protecting against the disease (that is, causing the clinical symptoms not to develop); inhibiting the disease (i.e., arresting or suppressing the development of clinical symptoms; and/or relieving the disease (i.e., causing the regression of clinical symptoms). As will be appreciated, it is not always possible to distinguish between "preventing" and "suppressing" a disease or disorder since the ultimate inductive event or events may be unknown or latent. Accordingly, the term "prophylaxis" will be understood to constitute a type of "treatment" that encompasses both "preventing" and "suppressing." The term "treatment" thus includes "prophylaxis".

The term "subject", "patient" or "individual" as used herein generally includes humans and non-human animals and preferably mammals (e.g., non-human primates, including marmosets, tamarins, spider monkeys, owl monkeys, vervet monkeys, squirrel monkeys, and baboons, macaques, chimpanzees, orangutans, gorillas; cows; horses; sheep; pigs; chicken; cats; dogs; mice; rat; rabbits; guinea pigs; etc.), including chimeric and transgenic animals and disease models. In the context of the present invention, the term "subject" preferably refers a non-human primate or a human, most preferably a human.

Accordingly, the present invention further provides methods of treating or preventing a lassa infection, by providing an mRNA, (pharmaceutical) composition, vaccine or kit-of-parts as defined herein, and applying or administering said mRNA, (pharmaceutical) composition, vaccine or kit-of-parts to a subject in need thereof, preferably in a pharmaceutically and/or therapeutically effective amount. Administration to the tissue or to the subject is preferably accomplished by subcutaneous, intramuscular or intradermal injection, preferably by intramuscular or intradermal injection, more preferably by intradermal injection. Preferably, injection is carried out by using conventional needle injection or jet injection, preferably by using jet injection.

The invention also relates to the use of the inventive mRNA, (pharmaceutical) composition, vaccine or kit-of-parts, preferably for modulating, preferably for inducing or enhancing, an immune response in a subject, more preferably for the treatment or prophylaxis of a lassa infection as defined herein.

Administration Routes

The inventive mRNA, (pharmaceutical) composition, vaccine or kit-of-parts can be administered, for example, systemically or locally.

Routes for systemic administration in general include, for example, transdermal, oral, parenteral routes, including subcutaneous, intravenous, intramuscular, intraarterial, intradermal and intraperitoneal injections and/or intranasal administration routes.

Routes for local administration in general include, for example, topical administration routes but also intradermal, transdermal, subcutaneous, or intramuscular injections or intralesional, intracranial, intrapulmonal, intracardial, and sublingual injections.

It is further conceivable to use different administration routes for different components of the inventive (pharmaceutical) composition, vaccine or kit-of-parts, for instance in case said (pharmaceutical) composition, vaccine or kit-of-parts comprises several mRNA species.

According to preferred embodiments, the inventive mRNA, (pharmaceutical) composition, vaccine or kit-of-parts is administered by a parenteral route, preferably via intradermal, subcutaneous, or intramuscular routes.

Preferably, said mRNA, (pharmaceutical) composition, vaccine or kit-of-parts is administered by injection, e.g. subcutaneous, intramuscular or intradermal injection, which may be needle-free and/or needle injection.

Accordingly, in preferred embodiments, the medical use and/or method of treatment according to the present invention involves administration of said mRNA, (pharmaceutical) composition, vaccine or kit-of-parts by subcutaneous, intramuscular or intradermal injection, preferably by intramuscular or intradermal injection, more preferably by intradermal injection. Such injection may be carried out by using conventional needle injection or jet injection, preferably by using jet injection.

Administration Regimen

The inventive mRNA, (pharmaceutical) composition, vaccine or kit-of-parts may be administered to a subject in need thereof several times a day, daily, every other day, weekly, or monthly; and may be administered sequentially or simultaneously.

In case the (pharmaceutical) composition, vaccine or kit-of-parts comprises several components (e.g. different mRNA species), said components may be administered to a subject in need thereof via different administration routes as defined above.

Such components may be administered simultaneously (i.e. at the same time via the same or different administrations routes) or separately (i.e. sequentially at different time points and/or via different administrations routes). Such a sequential administration scheme is also referred to as "time-staggered" administration. A time-staggered administration of the several components of the inventive (pharmaceutical) composition, vaccine or kit-of-parts may ensure that the separate mechanisms elicited by said components do not negatively influence each other. Time-staggered administration may for instance mean that one mRNA species is administrated e.g. prior, concurrent or subsequent to different mRNA species.

Dosage

The inventive mRNA, (pharmaceutical) composition, vaccine or kit-of-parts are preferably administered to the subject in need thereof in a "pharmaceutically effective" amount.

A "pharmaceutically effective amount" in the context of the invention is typically understood as an amount that is sufficient to induce a desired pharmaceutical effect, such as an immune response. Preferably, the administered amount of the inventive mRNA, (pharmaceutical) composition, vaccine or kit-of-parts is also "therapeutically effective", i.e. sufficient for the alleviation of the symptoms of the disease or condition being treated and/or for prophylaxis of the symptoms of the disease or condition being prevented. In other words, a "therapeutically effective amount" means an amount of the inventive mRNA, (pharmaceutical) composition, vaccine or kit-of-parts that is sufficient to significantly induce a positive modification of a disease or disorder, i.e. an amount of the active ingredient that elicits the biological or medicinal response in a tissue, system, animal or human that is being sought.

Therapeutic efficacy and toxicity of inventive mRNA, (pharmaceutical) composition, vaccine or kit-of-parts can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and can be expressed as the ratio LD50/ED50. mRNAs, (pharmaceutical) composition, vaccine or kit-of-parts which exhibit large therapeutic indices are generally preferred. The data obtained from the cell culture assays and animal studies can be used in formulating a range of dosage for use in humans. The dosage of such compounds lies preferably within a range of circulating concentrations that include the ED50 with little or no toxicity.

The term also includes an amount of the inventive mRNA, (pharmaceutical) composition, vaccine or kit-of-parts sufficient to reduce the progression of the disease, for instance to reduce or inhibit lassa virus replication. At the same time, however, a "therapeutically effective amount" is preferably small enough to avoid serious side-effects, i.e. to permit a sensible relationship between advantage and risk. The determination of these limits typically lies within the scope of sensible medical judgment. A "therapeutically effective amount" of the inventive mRNA, (pharmaceutical) composition, vaccine or kit-of-parts will furthermore vary in connection with the particular disease or condition to be treated, characteristics of the patient (including age, physical condition, body weight, sex and diet), concurrent treatments, pharmacokinetic properties of the active agent(s), treatment regime and the desired effect (amelioration vs. complete remission), etc.

For instance, therapeutically effective doses of the inventive mRNA, (pharmaceutical) composition, vaccine or kit-of-parts described herein may range from about 0.001 mg to 10 mg, preferably from about 0.01 mg to 5 mg, more preferably from about 0.1 mg to 2 mg per dosage unit or from about 0.01 nmol to 1 mmol per dosage unit, in particular from 1 nmol to 1 mmol per dosage unit, preferably from 1 pmol to 1 mmol per dosage unit. It is also envisaged that the therapeutically effective dose of the inventive mRNA, (pharmaceutical) composition, vaccine or kit-of-parts may range (per kg body weight) from about 0.01 mg/kg to 10 g/kg, preferably from about 0.05 mg/kg to 5 g/kg, more preferably from about 0.1 mg/kg to 2.5 g/kg.

The suitable amount of the inventive mRNA, (pharmaceutical) composition, vaccine or kit-of-parts according to the invention to be administered can be determined by routine experiments, e.g. by using animal models. Such models include, without implying any limitation, rabbit, sheep, mouse, rat, dog and non-human primate models.

Combination Therapy

The inventive mRNA, (pharmaceutical) composition, vaccine or kit-of-parts may also be used in combination therapy. Any other therapy useful for treating or preventing lassa virus infections may be combined with the uses and methods disclosed herein. Such therapies include, inter alia, the administration of Ribavirin.

Administration of the inventive mRNA, (pharmaceutical) composition, vaccine or kit-of-parts may be accomplished prior to, simultaneously and/or subsequently to administering another therapeutic or subjecting the patient to another therapy that is useful for treating or preventing lassa virus infections (such as Ribavirin administration).

BRIEF DESCRIPTION OF THE DRAWINGS

Figure 1:
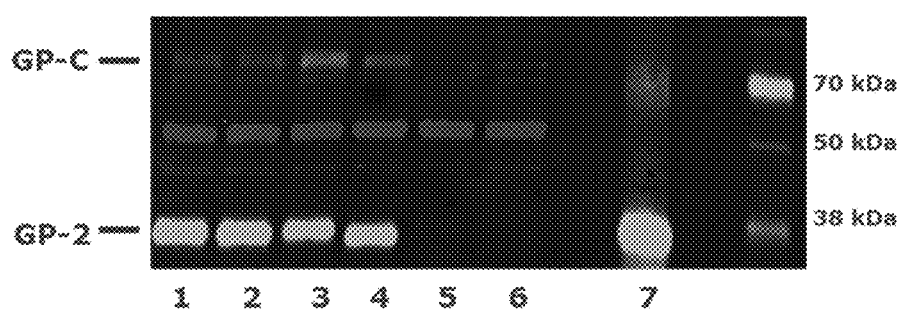

FIG. 1 shows that mRNA constructs encoding Lassa virus glycoprotein precursor (GPC) of different lassa virus clades (clade I, II, III and IV) were expressed and processed in vitro. Further details are provided in Example 3.

Figure 2:
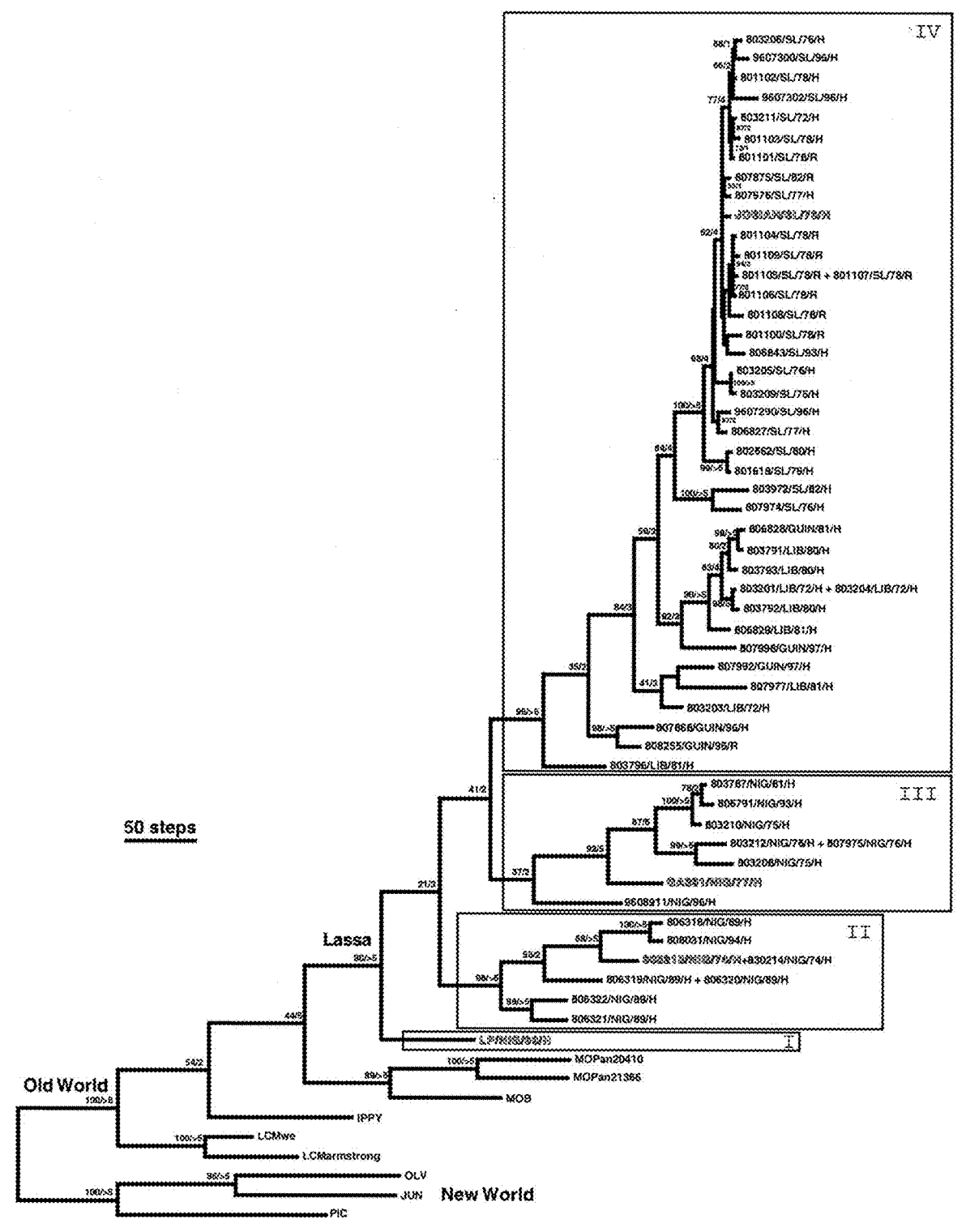

FIG. 2 Phylogenetic tree that shows relationships among Lassa virus strains.

EXAMPLES

The Examples shown in the following are merely illustrative and shall describe the present invention in a further way. These Examples shall not be construed to limit the present invention thereto.

Example 1: Preparation of mRNA Constructs for In Vitro and In Vivo Experiments 1.1. Preparation of DNA and mRNA constructs:

For the present Examples, DNA sequences encoding Lassa virus proteins are prepared and used for subsequent RNA in vitro transcription reactions. The generated RNA constructs (RNA sequences) are provided in the sequence listing (Lassa virus sequences: SEQ ID NOs: 5541, 5729, 5731, 5529, 5356, 5540, and 5913) and in Table 6 with the encoded proteins and virus origin and virus clade indicated.

TABLE 6 mRNA constructs used in the present examples

| RNA ID | Virus strain | Virus clade | Construct description | SEQ ID NO RNA | SEQ ID Protein | mRNA design |
|---|---|---|---|---|---|---|
| R6023/ R6630 | Josiah | clade IV | LASV(Josiah)-GPC(GC) | SEQ ID NO: 5541 | SEQ ID NO: 186 | design 2 |
| R6024 | Josiah | clade IV | LASV(Josiah)-NP(GC) | SEQ ID NO: 5729 | SEQ ID NO: 374 | design 2 |
| R6025 | Josiah | clade IV | LASV(Josiah)-Z(GC) | SEQ ID NO: 5731 | SEQ ID NO: 3451 | design 2 |
| R6026/ R6631 | LP | clade I | LASV(LP)-GPC(GC) | SEQ ID NO: 5529 | SEQ ID NO: 174 | design 2 |
| R6027/ R6632 | 803213 | clade II | LASV(803213)-GPC(GC) | SEQ ID NO: 5356 | SEQ ID NO: 1 | design 2 |
| R6028/ R6633 | GA391 | clade III | LASV(GA391)-GPC(GC) | SEQ ID NO: 5540 | SEQ ID NO: 185 | design 2 |
| R6717 | Josiah | clade IV | LASV(Josiah)-GPC(GC) | SEQ ID NO: 5013 | SEQ ID NO: 186 | design 1 |

DNA sequences are prepared by modifying the wild type encoding DNA sequences by introducing a GC-optimized sequence for stabilization, using an in silico algorithms that increase the GC content of the respective coding sequence. Moreover, sequences are introduced into a pUC19 derived vector and modified to comprise stabilizing sequences derived from alpha-globin-3'-UTR, a stretch of 30 cytosines, a histone-stem-loop structure, and a stretch of 64 adenosines at the 3'-terminal end (poly-A-tail) (indicated as "mRNA design 1" in Table 1-3 and 6). Other sequences were introduced into a pUC19 derived vector to comprise stabilizing sequences derived from 32L4 5'-UTR ribosomal 5'TOP UTR and 3'-UTR derived from albumin 7, a stretch of 30 cytosines, a histone-stem-loop structure, and a stretch of 64 adenosines at the 3'-terminal end (poly-A-tail) (indicated as "mRNA design 2" in Table 1-3 and 6). Generated mRNA constructs are provided in Table 6

The obtained plasmid DNA constructs are transformed and propagated in bacteria (*Escherichia coli*) using common protocols known in the art.

1.2. RNA In Vitro Transcription on Linearized pDNA:

The DNA plasmids prepared according to paragraph 1 are enzymatically linearized using EcoRI and transcribed in vitro using DNA dependent T7 RNA polymerase in the presence of a nucleotide mixture and cap analog (m7GpppG) under suitable buffer conditions. RNA production is performed under current good manufacturing practice according to WO2016/180430. The obtained mRNAs are purified using PureMessenger® (CureVac, Tubingen, Germany; WO2008/077592) and used for in vitro and in vivo experiments. The generated mRNA constructs are indicated as "mRNA design 1" and as as "mRNA design 2" in Table 1-3.

1.3. RNA In Vitro Transcription on PCR Amplified DNA Templates:

DNA plasmids prepared according to paragraph 1, or synthetic DNA constructs are used for PCR-amplification. The generated PCR templates are used for subsequent RNA in vitro transcription using DNA dependent T7 RNA polymerase in the presence of a nucleotide mixture and cap analog (m7GpppG) under suitable buffer conditions. The obtained mRNA constructs are purified using PureMessenger® (CureVac, Tubingen, Germany; WO2008/077592) and used for in vitro and in vivo experiments. The generated mRNA constructs are indicated as "mRNA design 3" in Table 1-3.

Example 2: Expression of Lassa Virus Proteins in HeLa Cells and Analysis by FACS To determine in vitro protein expression of the constructs, HeLa cells are transiently transfected with mRNA encoding Lassa virus antigens and stained using suitable customized anti-LASV antibodies (raised in rabbits), counterstained with a FITC-coupled secondary antibody.

HeLa cells are seeded in a 6-well plate at a density of 400,000 cells/well in cell culture medium (RPMI, 10% FCS, 1% L-Glutamine, 1% Pen/Strep), 24h prior to transfection. HeLa cells are transfected with 1 and 2 μg unformulated mRNA using Lipofectamine 2000 (Invitrogen). The mRNA constructs according to Example 1 are used in the experiment, including a negative control encoding an irrelevant protein.

24 hours post transfection, HeLa cells are stained with suitable anti anti-LASV antibodies (raised in rabbits; 1:200) and anti-rabbits FITC labelled secondary antibody (1:500) and subsequently analyzed by flow cytometry (FACS) on a BD FACS Canto II using the FACS Diva software. Quantitative analysis of the fluorescent FITC signal is performed using the FlowJo software package (Tree Star, Inc.).

Example 3: Expression of Lassa Virus Proteins Using Western Blot

The results of the present Example show that mRNA encoding Lassa Virus GPC protein are expressed and processed in Hela cells after transfection.

For the analysis of Lassa virus protein expression, HeLa cells are transfected with 1 μg and 2 μg unformulated mRNA using Lipofectamine as the transfection agent. Supernatants, harvested 24 hours post transfection, are filtered through a 0.2 μm filter. Clarified supernatants are applied on top of 1 ml 20% sucrose cushion (in PBS) and centrifuged at 14000 rcf (relative centrifugal force) for 2 hours at 4° C. Protein content is analyzed by Western Blot using suitable customized polyclonal anti-LASV antibodies (raised in rabbits) (1:1000) as primary antibody in combination with secondary anti rabbit antibody coupled to IRDye 800CW (Licor Biosciences). The presence of αβ-tubulin is also analyzed as control for cellular contamination (αβ-tubulin; Cell Signalling Technology; 1:1000 diluted) in combination with secondary anti mouse antibody coupled to IRDye 680RD (Licor Biosciences). For the analysis LASV proteins in cell lysates, HeLa cells were transfected with 2 μg unformulated mRNAs (generated according to Example 1, see Table 6) using Lipofectamine as the transfection agent 24 hours post transfection, HeLa cells are detached by trypsin-free/EDTA buffer, harvested, and cell lysates are prepared. Cell lysates are subjected to SDS-PAGE under denaturating and reducing conditions followed by western blot detection. Western Blot analysis is performed using suitable customized polyclonal rabbit anti-LASV GP antibodies (diluted 1:200) as primary antibody in combination with secondary anti anti-rabbit antibody coupled to IRDye 800CW (Licor Biosciences). The presence of αβ-tubulin was analyzed (αβ-tubulin; Cell Signalling Technology; 1:1000 diluted) in combination with secondary anti rabbit antibody coupled to IRDye 680RD (Licor Biosciences). Inactivated Lassa virus (Josiah) was used as positive control for the western blot. The outline of the experiment is shown in Table 7. The result of the experiment is shown in FIG. 1.

TABLE 7

Expression analysis experiment (Example 3):

| Lane | SEQ ID No | R# | encoded antigen | Lassa virus clade |
|---|---|---|---|---|
| 1 | SEQ ID NO: 5541 | R6023 | LASV(Josiah)-GP | clade IV |
| 2 | SEQ ID NO: 5529 | R6026 | LASV(LP)-GP | clade I |
| 3 | SEQ ID NO: 5356 | R6027 | LASV(803213)-GP | clade II |
| 4 | SEQ ID NO: 5540 | R6028 | LASV(GA391)-GP | clade III |
| 5 | SEQ ID NO: 5729 | R6024 | LASV(Josiah)-NP | clade IV |
| 6 | | | WFI | |
| 7 | | | Inactivated LASV Josiah | clade IV |

Results:

As shown in FIG. 1, mRNA constructs encoding lassa virus glycoprotein precursors (GPC) were expressed in vitro. Moreover, the expressed encoding lassa virus glycoprotein precursors were properly processed, thus cotranslationally cleaved by signal peptidases. The subunit protein GP2 was detected as expected. The results exemplify that the inventive mRNA encoding Lassa virus GPC protein is translated in cells and that alternative mRNA constructs according to the invention may also be translated in cells, which is a prerequisite for an mRNA-based vaccine.

Example 4: Vaccination of Mice with mRNA Encoding Lassa Virus Proteins

4.1. Preparation of Protamine Complexed mRNA ("Vaccine Composition 1"):

Lassa virus mRNA constructs are complexed with protamine prior to use in in vivo vaccination experiments. The mRNA complexation consists of a mixture of 50% free mRNA and 50% mRNA complexed with protamine at a weight ratio of 2:1. First, mRNA is complexed with protamine by addition of protamine-Ringer's lactate solution to mRNA. After incubation for 10 minutes, when the complexes are stably generated, free mRNA is added, and the final concentration of the vaccine is adjusted with Ringer's lactate solution.

4.2. Immunization:

Female BALB/c mice are injected intradermally (i.d.) with mRNA vaccine compositions with doses, application routes and vaccination schedules as indicated in Table 8. As a negative control, one group of mice is vaccinated with buffer (ringer lactate). All animals are vaccinated on day 0, 21 and 42. Blood samples are collected on day 21, 35, and 49 for the determination of antibody titers. Splenocytes are isolated on day 49 for T-cell analysis.

TABLE 8

Vaccination regimen (Example 4):

| Group | Number of mice | Vaccine composition | SEQ ID NO | Dose | Route/Volume |
|---|---|---|---|---|---|
| 1 | 6 | R6630 (Lassa GPC Josiah strain) | SEQ ID NO: 5541 | 80 μg | i. d. 2 × 50 μl |
| 2 | 6 | R6631 (Lassa GPC LP strain) | SEQ ID NO: 5529 | 80 μg | i. d. 2 × 50 μl |
| 3 | 6 | RiLa buffer | — | | |

4.3. Detection of Specific Humoral Immune Responses:

Hela cells are transfected with 2 μg of either R6630 or R6631 mRNA using lipofectamine. The cells are harvested 20h post transfection, and seeded at $1 \times 10^5$ per well into an 96 well plate. The cells are incubated with sera of the vaccinated mice (diluted 1:50) followed by a FITC-conjugated anti-mouse IgG antibody. Cells are acquired on BD FACS Canto II using DIVA software and analyzed by FlowJo.

4.4. Determination of Anti Lassa Virus Protein Antibodies by ELISA:

ELISA is performed using recombinant Lassa Glycoproteins for coating. Coated plates are incubated using respective serum dilutions, and binding of specific antibodies to the Lassa virus antigens are detected using biotinylated isotype specific anti-mouse antibodies followed by streptavidin-HRP (horse radish peroxidase) with ABTS as substrate. Endpoint titers of antibodies directed against the Lassa virus antigens are measured by ELISA on day 49 after three vaccinations.

4.5. Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates (2×106 cells per well). The cells are stimulated with recombinant LASV virus in the presence of 2.5 μg/ml of an anti-CD28 antibody (BD Biosciences) and α-CD107α-PE-Cy7 (1:100) for 24 hours at 37° C. After stimulation, cells are washed and stained for intracellular cytokines using the Cytofix/Cytoperm reagent (BD Biosciences) according to the manufacturer's instructions. The following antibodies are used for staining: anti-CD8-APC-H7 (1:100), anti-CD4-BD-Horizon V450 (1:200), anti-CD3-Thy1.2-FITC (1:200) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

Example 5: Preparation of Lassa Virus Vaccine Compositions

For further in vivo vaccination experiments, different compositions of Lassa virus mRNA vaccine are prepared using constructs obtained in Example 1. One composition comprises protamine-complexed mRNA, one composition comprises mRNA that is formulated without protamine ("naked"), one composition comprises mRNA that is encapsulated in lipid nanoparticles (LNPs), and one composition comprises polymer-lipidoid complexed mRNA.

5.1. Preparation of Protamine Complexed mRNA ("Vaccine Composition 1"):

Lassa Virus Virus mRNA Constructs are Complexed as Described in Example 4

5.2. Preparation of "Naked" mRNA ("Vaccine Composition 2"):

Lassa virus mRNA constructs are formulated without protamine. The final concentration of the vaccine is adjusted with Ringer's lactate solution.

5.3. Preparation of LNP Encapsulated mRNA ("Vaccine Composition 3"):

A lipid nanoparticle (LNP)-encapsulated mRNA mixture is prepared using an ionizable amino lipid (cationic lipid), phospholipid, cholesterol and a PEGylated lipid. LNPs are prepared as follows. Cationic lipid, DSPC, cholesterol and PEG-lipid are solubilized in ethanol. Briefly, mRNA mixture is diluted to a total concentration of 0.05 mg/mL in 50 mM citrate buffer, pH 4. Syringe pumps are used to mix the ethanolic lipid solution with the mRNA mixture at a ratio of about 1:6 to 1:2 (vol/vol). The ethanol is then removed and the external buffer replaced with PBS by dialysis. Finally, the lipid nanoparticles are filtered through a 0.2 μm pore sterile filter. Lipid nanoparticle particle diameter size is determined by quasi-elastic light scattering using a Malvern Zetasizer Nano (Malvern, UK).

5.4. Preparation of Polymer-Lipidoid Complexed mRNA ("Vaccine Composition 4"): 20 mg peptide (CHHHHHHRRRRHHHHHHC—NH2; SEQ ID NO: 3450) TFA salt was dissolved in 2 mL borate buffer pH 8.5 and stirred at room temperature for approximately 18h. Then, 12.6 mg PEG-SH 5000 (Sunbright) dissolved in N-methylpyrrolidone was added to the peptide solution and filled up to 3 mL with borate buffer pH 8.5. After 18h incubation at room temperature, the reaction mixture was purified and concentrated by centricon procedure (MWCO 10 kDa), washed against water, and lyophilized. The obtained lyophilisate was dissolved in ELGA water and the concentration of the polymer was adjusted to 10 mg/mL. The obtained polyethylene glycol/peptide polymers (HO-PEG 5000—S—(S—CHHHHHHRRRRHHHHHHC-S-)7—S— PEG 5000—OH—peptide component: SEQ ID NO: 3450) were used for further formulation and are hereinafter referred to as PB83.

Preparation of 3—C12—OH Lipidoid

First, lipidoid 3—C12 was obtained by acylation of tris(2-aminoethyl)amine with an activated lauric (C12) acid derivative, followed by reduction of the amide. Alternatively, it may be prepared by reductive amination with the corresponding aldehyde. Lipidoid 3—C12—OH was prepared by addition of the terminal C12 alkyl epoxide with the same oligoamine according to Love et al., pp. 1864-1869, PNAS, vol. 107 (2010), no. 5.

Preparation of Compositions with Nanoparticles of Polymer-Lipidoid Complexed mRNA First, ringer lactate buffer (RiLa; alternatively e.g. saline (NaCl) or PBS buffer may be used), respective amounts of lipidoid, and respective amounts of a polymer (PB83) were mixed to prepare compositions comprising a lipidoid and a peptide or polymer. Then, the carrier compositions were used to assemble nanoparticles with the mRNA by mixing the mRNA with respective amounts of polymer-lipidoid carrier and allowing an incubation period of 10 minutes at room temperature such as to enable the formation of a complex between the lipidoid, polymer and mRNA. In order to characterize the integrity of the obtained polymer-lipidoid complexed mRNA particles, RNA agarose gel shift assays were performed. In addition, size measurements were performed (gel shift assay, Zetasizer) to evaluate whether the obtained nanoparticles have a uniform size profile.

Example 6: Vaccination of Mice and Evaluation of Lassa Virus Specific Immune Response 6.1. Immunization:

Female BALB/c mice are injected intradermally (i.d.) and intramuscularly (i.m.) with respective mRNA vaccine compositions (prepared according to Example 5) with doses, application routes and vaccination schedules as indicated in Table 9. As a negative control, one group of mice is vaccinated with buffer (ringer lactate). All animals are vaccinated on day 1, 21 and 35. Blood samples are collected on day 21, 35, and 63 for the determination of binding and neutralizing antibody titers (see below). Splenocytes were isolated on day 49 for T-cell analysis.

TABLE 9

Vaccination regimen - Lassa virus experiment (Example 6)

| Group | Number of mice | Vaccine composition | Route/ Volume | Vaccination Schedule (day) |
|---|---|---|---|---|
| 1 | 10 | 40 μg Lassa virus RNA Composition 1 | i. d. 2 × 25 μl | 0/21/35 |
| 2 | 10 | 40 μg Lassa virus RNA Composition 1 | i. m. 2 × 25 μl | 0/21/35 |
| 3 | 10 | 20 μg Lassa virus RNA Composition 2 | i. d. 2 × 25 μl | 0/21/35 |
| 4 | 10 | 20 μg Lassa virus RNA Composition 2 | i. m. 2 × 25 μl | 0/21/35 |
| 5 | 10 | 10 μg Lassa virus RNA Composition 3 | i. d. 2 × 25 μl | 0/21/35 |
| 6 | 10 | 10 μg Lassa virus RNA Composition 3 | i. m. 2 × 25 μl | 0/21/35 |
| 7 | 10 | 40 μg Lassa virus RNA Composition 4 | i. d. 2 × 25 μl | 0/21/35 |
| 8 | 10 | 40 μg Lassa virus RNA Composition 4 | i. m. 2 × 25 μl | 0/21/35 |
| 9 | 10 | 100% RiLa Control | i. d. 2 × 25 μl | 0/21/35 |

6.2. Determination of Anti Lassa Virus Protein Antibodies by ELISA:

ELISA is performed using inactivated Lassa virus infected cell lysate or recombinant Lassa Glycoproteins for coating. Coated plates are incubated using respective serum dilutions, and binding of specific antibodies to the Lassa virus antigens are detected using biotinylated isotype specific anti-mouse antibodies followed by streptavidin-HRP (horse radish peroxidase) with ABTS as substrate. Endpoint titers of antibodies directed against the Lassa virus antigens are measured by ELISA on day 63 after three vaccinations.

6.3. Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates (2×106 cells per well). The cells are stimulated with recombinant LASV virus in the presence of 2.5 μg/mi of an anti-CD28 antibody (BD Biosciences) and α-CD107α-PE-Cy7 (1:100) for 24 hours at 37° C. After stimulation, cells are washed and stained for intracellular cytokines using the Cytofix/Cytoperm reagent (BD Biosciences) according to the manufacturer's instructions. The following antibodies are used for staining: anti-CD8-APC-H7 (1:100), anti-CD4-BD-Horizon V450 (1:200), anti-CD3-Thy1.2-FITC (1:200) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

6.4. Lassa Virus Plaque Reduction Neutralization Test (PRNT50):

Sera are analyzed by a plaque reduction neutralization test (PRNT50), performed as commonly known in the art. Briefly, obtained serum samples of vaccinated mice are incubated with Lassa virus. That mixture is used to infect cultured cells, and the reduction in the number of plaques is determined.

Example 7: Vaccination of Mice and Evaluation of Lassa Virus Specific Immune Response 7.1. Immunization:

Female BALB/c mice are injected intramuscularly (i.m.) with LNP encapsulated mRNA R6717 coding for GPC (LASV Josiah, SEQ ID NO: 5013, see Table 6, Example 1, "mRNA design 1" and "vaccine composition 3" prepared according to Example 5) with doses, application routes and vaccination schedules as indicated in Table 10. As a negative control, one group of mice is vaccinated with buffer (ringer lactate). All animals are vaccinated on day 1 and 21. Blood samples are collected on day 21 and 35 for the determination of binding and neutralizing antibody titers (see below). Splenocytes were isolated on day 35 for T-cell analysis.

TABLE 10

Vaccination regimen - Lassa virus experiment (Example 7)

| Group | Number of mice | Vaccine composition | Route/ Volume | Vaccination Schedule (day) |
|---|---|---|---|---|
| 1 | 6 | 5 μg Lassa virus RNA GPC (Josiah; R6717) vaccine composition 3 | i.d. 2 × 25 μl | 0/21 |
| 2 | 6 | 2 μg Lassa virus RNA GPC (Josiah; R6717) vaccine composition 3 | i.m. 2 × 25 μl | 0/21 |
| 3 | 6 | 1 μg Lassa virus RNA GPC (Josiah; R6717) vaccine composition 3 | i.d. 2 × 25 μl | 0/21 |
| 4 | 6 | 100% RiLa Control | i.m. 2 × 25 μl | 0/21 |

7.2. Determination of Anti Lassa Virus Protein Antibodies by ELISA:

ELISA is performed using inactivated Lassa virus infected cell lysate for coating. Coated plates are incubated using respective serum dilutions, and binding of specific antibodies to the Lassa virus antigens are detected using biotinylated isotype specific anti-mouse antibodies followed by streptavidin-HRP (horse radish peroxidase) with ABTS as substrate. Endpoint titers of antibodies directed against the Lassa virus antigens are measured by ELISA on day 35 after two vaccinations.

7.3. Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS splenocytes are seeded into 96-well plates (2×106 cells per well). The cells are stimulated with recombinant LASV virus in the presence of 2.5 µg/ml of an anti-CD28 antibody (BD Biosciences) and α-CD107α-PE-Cy7 (1:100) for 24 hours at 37° C. After stimulation, cells are washed and stained for intracellular cytokines using the Cytofix/Cytoperm reagent (BD Biosciences) according to the manufacturer's instructions. The following antibodies are used for staining: anti-CD8-APC-H7 (1:100), anti-CD4-BD-Horizon V450 (1:200), anti-CD3-Thy1. 2-FITC (1:200) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.)

7.4. Lassa Virus Plaque Reduction Neutralization Test (PRNT50):

Sera are analyzed by a plaque reduction neutralization test (PRNT50), performed as commonly known in the art. Briefly, obtained serum samples of vaccinated mice are incubated with Lassa virus. That mixture is used to infect cultured cells, and the reduction in the number of plaques is determined.

Example 8: Clinical Development of a Lassa Virus mRNA Vaccine Composition

To demonstrate safety and efficiency of the Lassa virus mRNA vaccine composition, a clinical trial (phase I) is initiated.

In the clinical trial, a cohort of human volunteers is intradermally or intramuscularly injected for at least two times.

In order to assess the safety profile of the vaccine compositions according to the invention, subjects are monitored after administration (vital signs, vaccination site tolerability assessments, hematologic analysis). The efficacy of the immunization is analyzed by determination of virus neutralizing titers (VNT) in sera from vaccinated subjects. Blood samples are collected on day 0 as baseline and after completed vaccination. Sera are analyzed for virus neutralizing antibodies.

SEQUENCE LISTING (6415 sequences)

SEQ ID NO: 1 - protein, 490 aa, Artificial Sequence
  derived and/or modified protein sequence (wt) from Lassa virus__AAF86703__GPC
MGQIITFFQEVPHVIEEVMNIVLIALSLLAILKGIYNVATCGLFGLISFLLLCGRSCSVTYKGVYELQTLELNMANLNMTMPLSCTKNNSHHYIMVGNETGLELTLTNTSIINHKFCNLSDAHKKNLYDHALMSIISTFHLSIPNFNQYEAMSCDFNGGKISVQYNLSHSFAVDAANHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNEAPGGYCLTRWMLIEAELKCFGNTAVAKCNEKHDEEFCDMLRLFDFNKQAIKRLKTEAQMSIQLINKAVNALINDQLIMKNHLRDIMGIPYCNYSRYWYLNHTVTGKTSLPRCWLVSNGSYLNETHFSDDIEQQADNMITEMLQKEYMDRQGKTPLGLVDLFVFSTSFYLISIFLHLVKIPTHRHIVGKPCPKPHRLNHMGICSCGLYKHPGVPVKWKR

SEQ ID NO: 2 - protein, 491 aa, Artificial Sequence
  derived and/or modified protein sequence (wt) from Lassa virus__AAG41802__GPC
MGQIVTFFQEVPHVIEEVMNIVLIALSILAVLKGLYNIATCGLIGLITFLLLCGRSCSSNLYKGVYELQSLDLNMETLNMTMPLSCTKNNSHHYIRVGNDTGLELTLTNTSILNHKFCNLSDAHKKDLYDHALMSIISTFHLSIPNFNQYEAMSCDFNGGKISVQYNLSHSYAIDAANHCGTVANGILQTFMRMAWGGSYIALDSGRGNWDCIMTSYQYLIIQNTTWENHCQFSRPSPIGYLGLLSQRTRDIYISRRLLGTFTWTLSDSEGNATPGGYCLTRWMLIEAELKCFGNTAVAKCNEKHDEEFCDMLRLFDFNKQAISRLKSEAQMSIQLINKAVNALINDQLIMKNHLRDIMGIPYCNYSKYWYLNHTITGKTSLPKCWLVSNGSYLNETHFSDDIEQQADNMITEMLQKEYMERQGKTPLGLVDLFVFSTSFYLISIFLRLVKIPTHRHIVGKPCPKPHRLNHMGICSCGLYKQPGVPVRWKR

SEQ ID NO: 3 - protein, 490 aa, Artificial Sequence
  derived and/or modified protein sequence (wt) from Lassa virus__AAL13212__GPC
MGQIVTFFQEVPHVIEEIMNIVLITLSLLAILKGVYNLATCGLIGLITFLFLCGRSCSMTYKGSYQLETLELNMETLNMTMPLSCTKNTSHHYIRVGNETGLELTLTNTSIINHKFCNLSDAHKKNLYDHSLMSIISTFHLSIPNFNQYEAMSCDFNGGKISIQYNLSHTYAGDAAKHCGTLANGILQTFMRMAWGGSYIALDSGRGNWDCIMTSYQYLIIQNTTWEDHCQFSRPSPIGYLGLLSQRTREIYISRRLLGTFTWTLSDSEGNENPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPRCWLVSNGSYLNETRFSDDIEQQADNMITEMLQKEYIDRQGKTPLGLVDLFVFSTSFYLISIFLHLIKIPTHRHIVGGPCPKPHRLNHKGICSCGLYKRPGVSVRWKR

SEQ ID NO: 4 - protein, 491 aa, Artificial Sequence
  derived and/or modified protein sequence (wt) from Lassa virus__AAO59512__GPC
MGQIVTFFQEVPHVIEEVMNIVLIALSILAVLKGLYNFATCGLVGLVAFLLLCGRSCTSSLYKGVYELQTLELNMETLNMTMPLSCTKNNSHHYIRVGNETGLELTLTNTSIINHKFCNLSDAHKKNLYDHALMSIISTFHLSIPNFNQYEAMSCDFNGGKISVQYNLSHSYAVDAAKHCGTVANGVLQTFMRMAWGGSYIALDSGHGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKTEAQMSIQLINKAVNALINDQLIMKNHLRDIMGIPYCNYSRYWYLNHTTTGKTSLPKCWLVSNGSYLNETRFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 5 - protein, 491 aa, Artificial Sequence
  derived and/or modified protein sequence (wt) from Lassa virus__AAT49000__GPC
MGQIVTFFQEVPHVIEEVMNIVLIALSILAVLKGLYNVATCGLIGLVTFLFLCGRSCSTSLYKGVYELQTLELNMETLNMTMPLSCTKNNSHHYIMVGNETGLELTLTNTSIINHKFCNLSDAHKKNLYDHTLMSIISTFHLSIPNFNQYEAMSCDFNGGKISVQYNLSHSYAVDAANHCGTVANGVLQTFMRMAWGGSYIALDSGRGNWDCIMTSYQYLVIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTVTGKTSLPKCWLVSNGSYLNETHFSDDIEQQADNLITEMLQKEYMERQGKTPLGLVDLFVFSTSFYLISIFLHLVKIPTHRHIVGKPCPKPHRLNHMGICSCGVYKQPGVPVRWKR

SEQ ID NO: 6 - protein, 491 aa, Artificial Sequence
  derived and/or modified protein sequence (wt) from Lassa virus__AAT49004__GPC
MGQIVTFFQEVPHVIEEVMNIVLIALSVLAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 7 - protein, 491 aa, Artificial Sequence
  derived and/or modified protein sequence (wt) from Lassa virus__AAT49008__GPC
MGQIVTFFQEVPHVIEEVMNIVLIALSILAVLKGLYNVATCGLIGLVTFLFLCGRSCSTTLYKGVYELQTLELNMETLNMTMPLSCTKNNSHHYIMVGNETGLELTLTNTSIINHKFCNLSDAHKKNLYDHTLMSIISTFHLSIPNFNQYEAMSCDFNGGKISVQYNLSHSYAVDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSRYWYLNHTVTGKTSLPKCWLVSNGSYLNETHFSDDIEQQADNLITEMLQKEYMERQGKTPLGLVDLFVFSTSFYLISIFLHLVKIPTHRHIVGKPCPKPHRLNHMGICSCGVYKQPGVPVRWKR

SEQ ID NO: 8 - protein, 490 aa, Artificial Sequence
  derived and/or modified protein sequence (wt) from Lassa virus__AAT49010__GPC
MGQIVTFFQEVPHVIEEVMNIVLIALSVLAILKGLYNFATCGLIGLVTFLLLSGRSCSMIYKGVYELQTLELNMETLNMTMPLSCTKNTSHHYIRVGNDTGLELTLTNETLLHHKFCNLSDAHKRNLYDHALMSIISTFHLSIPNFNQYEAMSCDFNGGKITVQYNLSHSYAVDAAKHCGTVANGVLQTFMRMAWGGSYIALDSRHGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTSTGKTSLPRCWLVSNGSYLNETHFSDDIEQQADNMITEMLQKEYLDRQGKTPLGLVDLFVFSTSFYLISIFLHLIKIPTHRHIVGKPCPKPHRLNHMGICSCGLYKQPGVPVRWKR

SEQ ID NO: 9 - protein, 490 aa, Artificial Sequence
  derived and/or modified protein sequence (wt) from Lassa virus__AAT49014__GPC
MGQIITFFQEVPHVIEEVMNIVLIALSLLAILKGLYNIATCGIIGLVAFLFLCGKSCSLTLKGGYELQTLELNMETLNMTMPLSCTKNSSHHYIRVGNETGLELTLTNTSIINHKFCNLSDAHKKNLYDHALMSIISTFHLSIPNFNQYEAMSCDFNGGKISVQYNLSHSYAGDAAEHCGTVANGVLQTFMRMAWGGRYIALDSGKGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTSSGRTSLPKCWLISNGSYLNETQFSDDIEQQADHMITEMLQKEYIERQGKTPLGLVDIFIFSTSFYLISIFLHLIKIPTHRHIVGKPCPKPHRLNHMGVCSCGLYKHPGVPTKWKR

SEQ ID NO: 10 - protein, 491 aa, Artificial Sequence
  derived and/or modified protein sequence (wt) from Lassa virus__AAV54104__GPC
MGQIVTFFQEVPHVIEEVMNIVLIALSVLAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGEDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 11 - protein, 491 aa, Artificial Sequence
  derived and/or modified protein sequence (wt) from Lassa virus__ADI39451__GPC
MGQIVTFFQEVPHVIEEVMNIVLIALSVLAVLKGLYNVATCGLIGLIAFLLLCGRSCTTTLYKGVYELQALELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTVANGVLQTFMRMAWGGSYIALDSGRGSWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTITGRTSLPKCWLVSNGSYLNETHFSDDIEQQADNMITEMLQKEYIERQGKTPLGLVDLFVFSTSFYLISIFLHLIKIPTHRHIVNKPCPKPHRLNHMGVCSCGLYKQPGVPVRWKR

SEQ ID NO: 12 - protein, 490 aa, Artificial Sequence
  derived and/or modified protein sequence (wt) from Lassa virus__ADU56610__GPC
MGQIVTFFQEVPHVIEEVMNIVLIALSLLAILKGIYNVATCGLFGLISFLLLCGRSCSTTYKGVYELQTLELDMANLNMTMPLSCTKNSSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNEAPGGYCLTRWMLIEAELKCFGNTAIAKCNEKHDEEFCDMLRLFDFNKQAIKRLKAEAQMSIQLINKAVNALINDQLIMKNHLRDIMGIPYCNYSKYWYLNHTVTGKTSLPRCWLISNGSYLNETHFSDDIEQQADNMITELLQKEYMDRQGKTPLGLVDLFVFSTSFYLISIFLHLVKIPTHRHIVGRPCPKPHRLNHMGICSCGLYKHPGVPVKWKR

SEQ ID NO: 13 - protein, 490 aa, Artificial Sequence
  derived and/or modified protein sequence (wt) from Lassa virus__ADU56618__GPC
MGQIVTFFQEVPHVIEEVMNIVLIALSILAILKGLYNIATCGLIGLVTFLLLSGRSCSMTYKGVYELQTLELNMNTLNMTMPLSCTKNNSHHYIMVGNETGLELTLTNTSLLHHKFCNLSDAHKKNLYDHTLMSIISTFHLSIPNFNQYEAMSCDFNGGKITVQYNLSHSYAIDAANHCGTVANGVLQTFMRMAWGGSYIALDSGRGKWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTSTGRTSLPRCWLVSNGSYLNETHFSDDIEQQADNMITEMLQKEYLDRQGKTPLGLVDLFVFSTSFYLISIFLHLVKIPTHRHIVGKPCPKPHRLNHMGICSCGLYKQPGVPVRWKR

SEQ ID NO: 14 - protein, 490 aa, Artificial Sequence
  derived and/or modified protein sequence (wt) from Lassa virus__ADU56622__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 15 - protein, 490 aa, Artificial Sequence
  derived and/or modified protein sequence (wt) from Lassa virus__ADU56626__GPC
MGQIITFFQEVPHVIEEVMNIVLIALSLLAILKGIYNVATCGLFGLVSFLLLCGRSCSTTYKGVYELQTLELNMASLNMTMPLSCTKNNSHHYIMVGNETGLELTLTNTSIINHKFCNLSDAHKRNLYDHALMSIISTFHLSIPNFNQYEAMSCDFNGGKISVQYNLSHTYAVDAAKHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 16 - protein, 490 aa, Artificial Sequence
  derived and/or modified protein sequence (wt) from Lassa virus__ADU56630__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVRIPTHRHVIGKPCPKPHRLNHMGICSCGLYKHPGVPVKWKR

SEQ ID NO: 17 - protein, 491 aa, Artificial Sequence
  derived and/or modified protein sequence (wt) from Lassa virus__AFY05588__GPC
MGQIVTFFQEVPHVIEEVMNIVLIALSVLAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGNWDCIMTSYQYLIIQNTTWEDHCQFSRPSPIGYLGLLSQRTRDLYISRRLLGTFTWTLSDSEGEDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 18 - protein, 491 aa, Artificial Sequence
  derived and/or modified protein sequence (wt) from Lassa virus__AFY05590__GPC
MGQIVTFFQEVPHVIEEVMNIVLIALSVLAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGNWDCIMTSYQYLIIQNTTWEDHCQFSRPSPIGYLGLLSQRTRDMYISRRLLGTFTWTLSDSEGEDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 19 - protein, 491 aa, Artificial Sequence
  derived and/or modified protein sequence (wt) from Lassa virus__AHC95553__GPC
MGQIVTFFQEVPHVIEEVMNIVLIALSILAVLKGLYNIATCGLIGLVTFFLLCGRSCSSNLYKGVYELQSLDLNMETLNMTMPLSCTKNNSHHYIRVGNETGLELTLTNTSLLDHKFCNLSDAHKKNLYDHALMSIISTFHLSIPNFNQYEAMSCDFNGGKITVQYNLSHSYAGDAARHCGTIANGVLQTFMRMAWGGSYIALDSGHGNWDCIMTSYQYLIIQNTTWEDHCQFSRPSPIGYLSLLSQRTRDIYISRRLLGTFTWTLSDSEGNATPGGYCLTRWMLIEAELKCFGNTAVAKCNEKHDEEFCDMLRLFDFNKQAISRLRSEAQMSIQLINKAVNALINDQLIMKNHLRDIMGIPYCNYSKYWYLNHTVTGRTSLPKCWLVSNGSYLNETHFSDDIEQQADNMITEMLQKEYMDRQGKTPLGLVDLFVFSTSFYLISIFLHLVKIPTHRHIVGKPCPKPHRLNRMGICSCGLYKQPGVPVKWKR

SEQ ID NO: 20 - protein, 491 aa, Artificial Sequence
  derived and/or modified protein sequence (wt) from Lassa virus__AHC95555__GPC
MGQIVTFFQEVPHVIEEVMNIVLIALSILAVLKGLYNIATCGLIGLVTFLLLCGRSCSSNLYKGVYELQSLDLNMETLNMTMPLSCTKNNSHHYIRAGNETGLELTLTNTSLINHKFCNLSDAHKKNLYDHTLMSIISTFHLSIPNFNQYEAMSCDFNGGKISVQYNLSHAYAIDAAEHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGNATPGGYCLTRWMLIEAELKCFGNTAVAKCNEKHDEEFCDMLRLFDFNKQAISRLKSEAQMSIQLINKAVNALINDQLIMKNHLRDIMGIPYCNYSKYWYLNHTITGRTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPLKWKR

SEQ ID NO: 21 - protein, 491 aa, Artificial Sequence
  derived and/or modified protein sequence (wt) from Lassa virus__AHC95557__GPC
MGQIVTFFQEVPHVIEEVMNIVLIALSILAVLKGLYNIATCGLIGLVTFFLLCGRSCSSNLYKGVYELQSLDLNMETLNMTMPLSCTKNNSHHYIRVGNETGLELTLTNTSLLNHKFCNLSDAHKRNLYDHALMSIISTFHLSIPNFNQYEAMSCDFNGGKITVQYNLSHSYAGDTAKHCGTIANGVLQTFMRMAWGGSYIALDSGHGNWDCIMTSYQYLIIQNTTWEDHCQFSRPSPIGYLGLLSQRTRDIYISRRLLGTFTWTLSDSEGNATPGGYCLTRWMLIEAELKCFGNTAVAKCNEKHDEEFCDMLRLFDFNKQAISRLRSEAQMSIQLINKAVNALINDQLIMKNHLRDIMGIPYCNYSKYWYLNHTVTGRTSLPKCWLVSNGSYLNETHFSDDIEQQADNMITEMLQKEYMDRQGKTPLGLVDLFVFSTSFYLISIFLHLVKIPTHRHIVGKPCPKPHRLNRMGICSCGLYKQPGVPVKWKR

SEQ ID NO: 22 - protein, 491 aa, Artificial Sequence
  derived and/or modified protein sequence (wt) from Lassa virus__AHC95559__GPC
MGQIITFFQEVPHVIEEVMNIVLIALSILAVLKGLYNIATCGLIGLVTFLLLCGRSCSSSLYKGVYELQSLDLNMETLNMTMPLSCTKNNSHHYIRVGNETGLELTLTNTSLINHKFCNLSDAHKKNLYDHALMSIISTFHLSIPNFNQYEAMSCDFNGGKISVQYNLSHAYAIDAASHCGTVANGVLQTFMRMAWGGSYIALDSGHGNWDCIMTSYQYLIIQNTTWEDHCQFSRPSPIGYLGLLSQRTRDIYISRRLLGTFTWTLSDSEGNATPGGYCLTRWMLIEAELKCFGNTAVAKCNEKHDEEFCDMLRLFDFNKQAISRLKSEAQMSIQLINKAVNALINDQLIMKNHLRDIMGIPYCNYSKYWYLNHTVTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 23 - protein, 491 aa, Artificial Sequence
  derived and/or modified protein sequence (wt) from Lassa virus__AIT17126__GPC
MGQIVTFFQEVPHVIEEVMNIVLIALSILAVLKGLYNFATCGLVGLLTFLLLCGRSCTTGLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAADHCGTVANGVLQTFMRMAWGGSYIALDSGRGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLVMKNHLRDIMGIPYCNYSRYWYLNHTTTGRTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 24 - protein, 491 aa, Artificial Sequence
  derived and/or modified protein sequence (wt) from Lassa virus__AIT17130__GPC
MGQIVTFFQEVPHVIEEVMNIVLIALSILAVLKGLYNFATCGFVGLVTFLLLCGRSCTTSLYKGVYELQTLELNMETLNMTMPLSCTKNNSHHYIRVGNDTGLELTLTNTSIINHKFCNLSDAHKKNLYDHALMSIISTFHLSIPNFNQYEAMSCDFNGGKISVQYNLSHSYAVDAASHCGTIANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 25 - protein, 491 aa, Artificial Sequence
  derived and/or modified protein sequence (wt) from Lassa virus__AIT17134__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 26 - protein, 491 aa, Artificial Sequence
  derived and/or modified protein sequence (wt) from Lassa virus__AIT17138__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSLINHKFCNLSDAHKKNLYDHALMSIISTFHLSIPNFNQYEAMSCDFNGGKISVQYNLSHSYAVDAASHCGTVANGVLQTFMRMAWGGSYIALDSGRGGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPRCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 27 - protein, 491 aa, Artificial Sequence
  derived and/or modified protein sequence (wt) from Lassa virus__AIT17142__GPC
MGQIVTFFQEVPHVIEEVMNIVLIALSVLAVLKGLYNFATCGIVGLVTFLLLCGRSCTTSLYKGVYELQTLELNMETLNMTMPLSCTKNNSHHYIMVGNDTGLELTLTNTSIINHKFCNLSDAHKKNLYDHALMSIISTFHLSIPNFNQYEAMSCDFNGGKISVQYNLSHSYAGDAADHCGTVANGVLQTFMRMAWGGSYIALDSGRGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 28 - protein, 491 aa, Artificial Sequence
  derived and/or modified protein sequence (wt) from Lassa virus__AIT17146__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGRWDCIMTSYQYLIIQNTTWEDHCSFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGFYKQPGVPVKWKR

SEQ ID NO: 29 - protein, 491 aa, Artificial Sequence
  derived and/or modified protein sequence (wt) from Lassa virus__AIT17154__GPC
MGQIVTFFQEVPHVIEEVMNIVLIALSILAVLKGLYNFATCGIVGLVSFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTIANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHVVGKSCPKPHRLNHMGICSCGLYGQPGVPVKWKR

SEQ ID NO: 30 - protein, 491 aa, Artificial Sequence
  derived and/or modified protein sequence (wt) from Lassa virus__AIT17158__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 31 - protein, 491 aa, Artificial Sequence
  derived and/or modified protein sequence (wt) from Lassa virus__AIT17164__GPC
MGQIVTFFQEVPHVIEEVMNIVLIALSILAVLKGLYNFATCGLVGLVTFLLLCGRSCTSSLYKGVYELQTLELNMETLNMTMPLSCTKNNSHHYIRVGNETGLELTLTNTSIIDHKFCNLSDAHKKNLYDHALMSIISTFHLSIPNFNQYEAMSCDFNGGKISVQYNLSHSYAGDAAKHCGTVANGVLQTFMRMAWGGSYIALDSGHGNWDCIMTSYQYLIIQNTTWEDHCQFSRPSPIGYLGLLSQRTRDIYISRRLLGTFTWTLSDSEGNDAPGGYCLTRWMLIQAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPRCWLVSNGSYLNETHFSDDIEQQADNMITEMLQKEYMERQGKTPLGLVDLFVFSTSFYLISIFLHLVKIPTHRHIVGKSCPKPHRLNHMGICSCGLFKQPGVPVKWKR

SEQ ID NO: 32 - protein, 491 aa, Artificial Sequence
  derived and/or modified protein sequence (wt) from Lassa virus__AIT17168__GPC
MGQIVTFFQEVPHVIEEVMNIVLIALSILAVLKGLYNFATCGLVGLLTFLLLCGRSCTASRYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGHGSWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 33 - protein, 491 aa, Artificial Sequence
  derived and/or modified protein sequence (wt) from Lassa virus__AIT17172__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPRPHRLNHMGICSCGLYKQPGVPVKWKR

SEQ ID NO: 34 - protein, 491 aa, Artificial Sequence
  derived and/or modified protein sequence (wt) from Lassa virus__AIT17176__GPC
MGQIVTFFQEVPHVIEEVMNIVLIALSLLAVLKGLYNVATCGLIGLITFLLLCGRSCTTNLYKGVYELQALELNMETLNMTMPLSCTKNNSHHYIMVGNETGLELTLTNTSIINHKFCNLSDAHKKNLYDHALMSIISTFHLSIPNFNQYEAMSCDFNGGRISVQYNLSHSYAGDAASHCGTIANGVLQTFMRMAWGGSYIALDSGHGGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTVTGKTSLPKCWLVSNGSYLNETHFSDDIEQQADNMITEMLQKEYMERQGKTPLGLVDLFVFSTSFYLISIFLHLVKIPTHRHVVGKPCPKPHRLNHMGICSCGLYKQPGVPVRWKR

SEQ ID NO: 35 - protein, 491 aa, Artificial Sequence
  derived and/or modified protein sequence (wt) from Lassa virus__AIT17180__GPC
MGQIVTFFQEVPHVIEEVMNIVLIALSILAVLKGLYNVATCGLIGLVTFLLLCGRSCTTTLYKGVYELQTLELNMETLNMTMPLSCTKNNSHHYIRVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGNWDCIMTSYQYLIIQNTTWDDHCQFSRPSPIGYLGLLSQRTRDVYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNNTATGKTSLPKCWLISNGSYLNETHFSDDIEQEADNMITEMLQKEYMERQGKTPLGLVDLFVFSTSFYLISIFLHLVKIPTHRHIVGKSCPKPHRLNHMGICSCGLYKQPGVPVRWKR

SEQ ID NO: 36 - protein, 491 aa, Artificial Sequence
  derived and/or modified protein sequence (wt) from Lassa virus__AIT17184__GPC
MGQIVTFFQEVPHVIEEVMNIVLIALSILAVLKGLYNVATCGLIGLVTFLLLCGRSCTTTLYKGVYELQALELNMETLNMTMPLSCTKNNSHHYIRVGNETGLELTLTNTSIIDHKFCNLSDAHKKNLYDHALMSIISTFHLSIPNFNQYEAMSCDFNGGKISVQYNLSHSYAGDAANHCGTVANGVLQTFMRMAWGGSYIALDSGRNGWDCIMTSYQYLIIQNTTWDDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNNTATGKTSLPRCWLVSNGSYLNETHFSDDIEQQADNMITEMLQREYMERQGKTPLGLVDLFVFSTSFYLISIFLHLVKIPTHRHIVGKPCPKPHRLNHMGICSCGLYKQPGVPVKWKR

SEQ ID NO: 37 - protein, 491 aa, Artificial Sequence
  derived and/or modified protein sequence (wt) from Lassa virus__AIT17188__GPC
MGQIVTFFQEVPHVIEEVMNIVLIALSILAVLKGLYNFATCGFVGLVSFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAVDAANHCGTVANGVLQTFMRMAWGGSYIALDSGHGSWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLRAEAQMSIQLINKAVNALINDQLIMKNHLRDIMGIPYCNYSKYWYLNHTTTGRTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYGQPGVPVKWKR

SEQ ID NO: 38 - protein, 491 aa, Artificial Sequence
  derived and/or modified protein sequence (wt) from Lassa virus__AIT17192__GPC
MGQIVTFFQEVPHVIEEVMNIVLIALSILAVLKGLYNFATCGFIGLVSFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQFEAMSCDFNGGKISVQYNLSHSYAVDAANHCGTVANGVLQTFMRMAWGGSYIALDSGHGSWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYGQPGVPVKWKR

SEQ ID NO: 39 - protein, 491 aa, Artificial Sequence
  derived and/or modified protein sequence (wt) from Lassa virus__AIT17196__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMNIQLINKAVNALINDQLIMKNHLRDIMGIPYCNYSKYWYLNHTTTGKTSLPRCWLVSNGSYLNETHFSDDIEQQADNMITEMLQKEYMERQGKTPLGLVDLFVFSTSFYLISIFLHLVKIPTHRHIVGKPCPKPHRLNHMGICSCGFYKQPGVPVKWKR

SEQ ID NO: 40 - protein, 491 aa, Artificial Sequence
  derived and/or modified protein sequence (wt) from Lassa virus__AIT17204__GPC
MGQIVTFFQEVPHVIEEVMNIVLIALSILAVLKGLYNLATCGLVGLVTFLLLCGRSCTSSLYKGVYELQTLELNMETLNMTMPLSCTKNSSHHYIRVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGHDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTITGKTSLPKCWLVSNGSYLNKTHFSDDIEQQADNMITEMLQKEYMERQGKTPLGLVDLFVFSTSFYLISIFLHLIKIPTHRHIVGKPCPKPHRLNHMGICSCGLYKQPGVPVKWKR

SEQ ID NO: 41 - protein, 491 aa, Artificial Sequence
  derived and/or modified protein sequence (wt) from Lassa virus__AIT17208__GPC
MGQIVTFFQEVPHVIEEVMNIVLIALSILAVLKGLYNFATCGLIGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGQWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 42 - protein, 491 aa, Artificial Sequence
  derived and/or modified protein sequence (wt) from Lassa virus__AIT17210__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLRLVKIPTHRHIVGKPCPKPHRLNHMGICSCGLYKQPGVPVKWKR

SEQ ID NO: 43 - protein, 491 aa, Artificial Sequence
  derived and/or modified protein sequence (wt) from Lassa virus__AIT17212__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIINHKFCNLSDAHRKNLYDHALMSIISTFHLSIPNFNQYEAMSCDFNGGKISVQYNLSHSYAGDAANHCGTVANGVLQTFMRMAWGGSYIALDSGRGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPRCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 44 - protein, 491 aa, Artificial Sequence
  derived and/or modified protein sequence (wt) from Lassa virus__AIT17216__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGHGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNYMGICSCGLYKQPGVPVRWKR

SEQ ID NO: 45 - protein, 491 aa, Artificial Sequence
  derived and/or modified protein sequence (wt) from Lassa virus__AIT17224__GPC
MGQIVTFFQEVPHVIEEVMNIVLIALSILAVLKGLYNVATCGLIGLVTFLLLCGRSCTTTLYKGVYELQALELNMETLNMTMPLSCTKNNSHHYIRVGNDTGLELTLTNTSIIQHKFCNLSDAHKKNLYDHTLMSIISTFHLSIPNFNQYEAMSCDFNGGKISVQYNLSHSYAGDAASHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGRDTPGGYCLTRWMLIEAELKCFGNTAVAKCNEKHDEEFCDMLRLFDFNKQAIQRLKTEAQMSIQLINKAVNALINDQLIMKNHLRDIMGIPYCNYSKYWYLNNTITGKSSLPKCWLVSNGSYLNETHFSDDIEQEADNMITEMLQKEYMERQGKTPLGLVDLFVFSTSFYLISIFLHLVKIPTHRHIVGKPCPKPHRLNHMGVCSCGLYKQPGVPVRWKR

SEQ ID NO: 46 - protein, 491 aa, Artificial Sequence
  derived and/or modified protein sequence (wt) from Lassa virus__AIT17228__GPC
MGQIVTFFQEVPHVIEEVMNIVLIALSILAVLKGLYNFATCGLVGLLTFLLLCGRSCTTSLYKGVYELQTLELNMETLNMTMPLSCTKNNSHHYIMVGNETGLELTLTNTSIIDHKFCNLSDAHKKNLYDHALMSIISTFHLSIPNFNQYEAMSCDFNGGKISVQYNLSHSYAGDAANHCGTVANGVLQTFMRMAWGGSYIALDSGRGGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 47 - protein, 491 aa, Artificial Sequence
  derived and/or modified protein sequence (wt) from Lassa virus__AIT17232__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIRVGNETGLELTLTNTSIINHKFCNLSDAHKKNLYDHALMSIISTFHLSIPNFNQYEAMSCDFNEGKISVQYNLSHSYAGDAANHCGTVANGVLQTFMRMAWGGSYIALDSGRGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIERLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 48 - protein, 491 aa, Artificial Sequence
  derived and/or modified protein sequence (wt) from Lassa virus__AIT17236__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGRISVQYNLSHSYAGEAANHCGTVANGVLQTFMRMAWGGSYIALDSGRGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSRYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 49 - protein, 491 aa, Artificial Sequence
  derived and/or modified protein sequence (wt) from Lassa virus__AIT17240__GPC
MGQIVTFFQEVPHVIEEVMNIVLIALSILAVLKGLYNLATCGLVGLVTFLLLCGRSCTTSLYKGFYELQTLELNMETLNMTMPLSCTKNNSHHYIRVGNETGLELTLTNTSIIDHKFCNLSDAHKKNLYDHALMSIISTFHLSIPNFNQYEAMSCDFNGGKISVQYNLSHSYAGDAANHCGTVANGVLQTFMRMAWGGSYIALDSGRGRWDCIMTSYQYLIIQNTTWEDHCQFSRPSPIGYLGLLSQKTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 50 - protein, 491 aa, Artificial Sequence
  derived and/or modified protein sequence (wt) from Lassa virus__AIT17244__GPC
MGQIVTFFQEVPHVIEEVMNIVLIALSILAVLKGLYNLATCGLVGLVTFLLLCGRSCTTNLYKGVYELQTLELNMETLNMTMPLSCTKNSSHHYIRVGNETGLELTLTNTSIIDHKFCNLSDAHKKNLYDHALMSIISTFHLSIPNFNQYEAMSCDFNGGKISVQYNLSHSYVGDAADHCGTVANGVLQTFMRMAWGGSYIALDSGRGKWDCIITSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTITGKTSLPRCWLVSNGSYLNETRFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 51 - protein, 491 aa, Artificial Sequence
  derived and/or modified protein sequence (wt) from Lassa virus__AIT17246__GPC
MGQIVTFFQEVPHVIEEVMNIVLIALSLLAVLKGLYNVATCGLIGLITFLLLCGRSCTTNLYKGVYELQTLELNMETLNMTMPLSCTKNSSHHYIMVGNETGLELTLTNTSIINHKFCNLSDAHKKNLYDHTLMSIISTFHLSIPNFNQYEAMSCDFNGGKISVQYNLSHSYAVDAANHCGTVANGILQTFMRMAWGGSYIALDSGRGNWDCIMTSYQYLIIQNTTWEDHCQFSRPSPIGYLGLLSQRTRDIYISRRLLGTFTWTLSDSEGNDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVRWKR

SEQ ID NO: 52 - protein, 491 aa, Artificial Sequence
  derived and/or modified protein sequence (wt) from Lassa virus__AIT17250__GPC
MGQIVTFFQEVPHVIEEVMNIVLIALSLLAVLKGLYNVATCGLIGLVTFLLLCGRSCTTNLYKGVYELQTLELNMETLNMTMPLSCTKNNSHHYIMVGNETGLELTLTNTSIINHKFCNLSDAHKKNLYDHTLMSIISTFHLSIPNFNQYEAMSCDFNGGKISVQYNLSHSYAVDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGNDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVRWKR

SEQ ID NO: 53 - protein, 491 aa, Artificial Sequence
  derived and/or modified protein sequence (wt) from Lassa virus__AIT17254__GPC
MGQIVTFFQEVPHVIEEVMNIVLIALSILAVLKGLYNFATCGIVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRDRWDCIMTSYQYLIIQNTTWEDHCQFSRPSPIGYLGLLSQRTRDIYISRRLLGTFTWTLSDSEGKNTPGGYCLTRWMLIEAELKCFGNTAVAKCNEKHDEEFCDMLRLFDFNKQAIQRLKAEAQMSISLINKAVNALINDQLIMKNHLRDIMGIPYCNYSKYWYLNHTTTGKTSLPRCWLVSNGSYLNETHFSDDIEQQADNMITEMLQKEYMDRQGKTPLGLVDLFVFSTSFYLISIFLHLVKIPTHRHIVGKTCPKPHRLNHMGICSCGLYKQPGVPVKWKR

SEQ ID NO: 54 - protein, 491 aa, Artificial Sequence
  derived and/or modified protein sequence (wt) from Lassa virus__AIT17258__GPC
MGQIVTFFQEVPHVIEEVMNIVLIALSILAVLKGLYNIATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIVSTFHLSIPNFNQYEAMSCDFNGGKISVQYNLSHSYAVDAANHCGTVANGVLQTFMRMAWGGSYIALDSGRGGWDCIMTSYQYLIIQNVTWEDHCQFSRPSPIGYLGLLSQRTRDVYISRRLLGTFTWTLSDSEGNDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 55 - protein, 491 aa, Artificial Sequence
  derived and/or modified protein sequence (wt) from Lassa virus__AIT17262__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAATHCGTVANGVLQTFMRMAWGGSYIALDSGRGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKTEAQMSIQLINKAVNALINDQLIMKNHLRDIMGIPYCNYSKYWYLNHTTTGKTSLPRCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 56 - protein, 491 aa, Artificial Sequence
  derived and/or modified protein sequence (wt) from Lassa virus__AIT17266__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSLINHKFCNLSDAHKKNLYDHALMSIISTFHLSIPNFNQYEAMSCDFNGGKISVQYNLSHSYAVDAANHCGTVANGVLQTFMRMAWGGSYIALDSGRGGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPRCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 57 - protein, 491 aa, Artificial Sequence
  derived and/or modified protein sequence (wt) from Lassa virus__AIT17270__GPC
MGQIVTFFQEVPHVIEEVMNIVLIALSVLAVLKGLYNFATCGLVGLVTFLLLCGRSCSTSVYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAVDAANHCGTVANGVLQTFMRMAWGGSYIALDSGHGGWDCIMTNYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPKCWLVSNGSYLNETHFSDDIEQQADNMITEMLQREYMERQGKTPLGLVDLFVFSTSFYLISIFLHLVKIPTHRHIVGKSCPKPHRLNHMGICSCGLYKQPGVPVKWKR

SEQ ID NO: 58 - protein, 491 aa, Artificial Sequence
  derived and/or modified protein sequence (wt) from Lassa virus__AIT17274__GPC
MGQIVTFFQEVPHVIEEVMNIVLIALSILAVLKGLYNVATCGLTGLVAFLLLCGRSCTTTLYKGVYELQALELNMETLNMTMPLSCTKNNSHHYIRVGNETGLELTLTNTSIIEHRFCNLSDAHKKNLYDHALMSIISTFHLSIPNFNQYEAMSCDFNGGKISVQYNLSHSYAVDAANHCGTVANGVLQTFMRMAWGGSYIALDSGRNGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNNTATGKTSLPRCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGAPVRWKR

SEQ ID NO: 59 - protein, 491 aa, Artificial Sequence
  derived and/or modified protein sequence (wt) from Lassa virus__AIT17276__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGHGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVRWKR

SEQ ID NO: 60 - protein, 490 aa, Artificial Sequence
  derived and/or modified protein sequence (wt) from Lassa virus__AIT17280__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIRVGNETGLELTLTNTSIIDHKFCNLSDAHKKNLYDHALMSIISTFHLSIPNFNQYEAMSCDFNGGKISVQYNLSHSYAGDAANHCGTVANGVLQTFMRMAWGGSYIALDSGHEWDCIMTSYQYLIIQNTTWDNHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKVEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGFYKQPGVPVKWKR

SEQ ID NO: 61 - protein, 491 aa, Artificial Sequence
  derived and/or modified protein sequence (wt) from Lassa virus__AIT17288__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAVDAANHCGTVANGVLQTFMRMAWGGGYIALDSGRGNWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTVTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVRWKR

SEQ ID NO: 62 - protein, 491 aa, Artificial Sequence
  derived and/or modified protein sequence (wt) from Lassa virus__AIT17292__GPC
MGQIVTFFQEVPHVIEEVMNIVLIALSIMAVLKGLYNIATCGLVGLVTFLLLCGRSCTTTLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGHGGWDCIMTSYQYLIIQNTTWEDHCQFTRPSPIGYLGLLSQRTRDIYISRRLLGTFTWTLSDSEGNDTPGGYCLTRWMLIEAELKCFGNTAVAKCNEKHDEEFCDMLRLFDFNKQAIQRLRAEAQMSIQLINKAVNALINDQLIMKNHLRDIMGIPYCNYSKYWYLNHTTTGRTSLPRCWLVSNGSYLNETHFSDDIEQQADNMITEMLQKEYMERQGKTPLGLVDLFVFSTSFYLISIFLHLIKIPTHRHIVGKPCPKPHRLNHMGVCSCGLYKQPGVPVRWKR

SEQ ID NO: 63 - protein, 491 aa, Artificial Sequence
  derived and/or modified protein sequence (wt) from Lassa virus__AIT17294__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIIDHKFCNLSDAHKKNLYDHALMSIISTFHLSIPNFNQYEAMSCDFNGGKISVQYNLSHSYAGDAANHCGTVANGVLQTFMRMAWGGSYIALDSGRGGWDCIMTSYQYLIIQNTTWEDHCQFSRPSPVGYLGLLSQRTRDIYISRRLLGTFTWTLSDSEGKDTPGGYCLTRWMLIEAELKCFGNTAVAKCNEKHDEEFCDMLRLFDFNKQAIQRLKTEAQMSIQLINKAVNALINDQLIMKNHLRDIMGIPYCNYSKYWYLNHTTTGKTSLPRCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 64 - protein, 491 aa, Artificial Sequence
  derived and/or modified protein sequence (wt) from Lassa virus__AIT17298__GPC
MGQIVTFFQEVPHVIEEVMNIVLIALSILAVLKGLYNIATCGLLGLVCFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAVDAASHCGTIANGVLQTFMRMAWGGSYIALDSGHGGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHVVGKPCPKPHRLNHMGICSCGLYGQPGVPVKWKR

SEQ ID NO: 65 - protein, 491 aa, Artificial Sequence
  derived and/or modified protein sequence (wt) from Lassa virus__AIT17302__GPC
MGQIVTFFQEVPHVIEEVMNIVLIALSLLAVLKGLYNVATCGLIGLVTFLLLCGRSCTTNLYKGVYELQTLELNMETLNMTMPLSCTKNNSHHYIMVGNETGLELTLTNTSIISHKFCNLSDAHKKNLYDHTLMSIISTFHLSIPNFNQYEAMSCDFNGGKISVQYNLSHSYAVDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGNDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVRWKR

SEQ ID NO: 66 - protein, 491 aa, Artificial Sequence
  derived and/or modified protein sequence (wt) from Lassa virus__AIT17310__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAATHCGTVANGVLQTFMRMAWGGSYIALDSGRGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKTEAQMSIQLINKAVNALINDQLIMKNHLRDIMGIPYCNYSKYWYLNHTTTGKTSLPRCWLVSNGSYLNETHFSDDIEQQADNMITEMLQKEYMERQGKTPLGLVDLFVFSTSFYLISIFLHLVKIPTHRHIVGKPCPKPHRLNYMGICSCGLYKQPGVPVKWKR

SEQ ID NO: 67 - protein, 491 aa, Artificial Sequence
  derived and/or modified protein sequence (wt) from Lassa virus__AIT17314__GPC
MGQIVTFFQEVPHVIEEVMNIVLITLSILAVLKGLYNVATCGLVGLVTFLLLCGRSCTTSLYKGVYELQTLELNMETLNMTMPLSCTKNNSHHYIMVGNETGLELTLTNTSIINHKFCNLSDAHKKDLYDHALMSIISTFHLSIPNFNQYEAMSCDFNGGKISVQYNLSHSYAVDAANHCGTVANGVLQTFMRMAWGGSYIALDSGRGGWDCIMTSYQYLIIQNTTWEDHCQFSRPSPIGYLGLLSQRTRDIYISRRLLGTFTWTLSDSEGNDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 68 - protein, 491 aa, Artificial Sequence
  derived and/or modified protein sequence (wt) from Lassa virus__AIT17318__GPC
MGQIVTFFQEVPHVIEEVMNIVLIALSLLAVLKGLYNVATCGLIGLVTFLLLCGRSCTTNLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAVDAANHCGTVANGVLQTFMRMAWGGSYIALDSGRGNWDCIMTSYQYLIIQNITWEDHCQFSRPSPIGYLGLLSQRTRDIYISRRLLGTFTWTLSDSEGNDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVRWKR

SEQ ID NO: 69 - protein, 491 aa, Artificial Sequence
  derived and/or modified protein sequence (wt) from Lassa virus__AIT17322__GPC
MGQIVTFFQEVPHVIEEVMNIVLIALSLLAVLKGLYNVATCGLIGLVTFLLLCGRSCTTNLYKGAYELQTLELNMETLNMTMPLSCTKNNSHHYIMVGNETGLELTLTNTSIINHKFCNLSDAHKKNLYDHTLMSIISTFHLSIPNFNQYEAMSCDFNGGKISVQYNLSHSYAVDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGNDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVRWKR

SEQ ID NO: 70 - protein, 491 aa, Artificial Sequence
  derived and/or modified protein sequence (wt) from Lassa virus__AIT17328__GPC
MGQIVTFFQEVPHVIEEVMNIVLITLSILAVLKGLYNIATCGLVGLVTFLLLCGKSCTTSLYKGVYELQTLELNMETLNMTMPLSCTKNNSHHYIRVGNETGLELTLTNTSIINHKFCNLSDAHKKNLYDHALMSIISTFHLSIPNFNQYEAMSCDFNGGKISVQYNLSHSYAVDAANHCGTVANGVLQTFMRMAWGGSYIALDSGHGNWDCIMTSYQYLIIQNTTWEDHCQFSRPSPIGYLGLLSQRTRDIYISRRLLGTFTWTLSDSEGNDAPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHVVGKSCPKPHRLNHMGICSCGLYKQPGVPVKWKR

SEQ ID NO: 71 - protein, 491 aa, Artificial Sequence
  derived and/or modified protein sequence (wt) from Lassa virus__AIT17332__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIRVGNETGLELTLTNTSIINHKFCNLSDAHKKNLYDHALMSIISTFHLSIPNFNQYEAMSCDFNGGKISVQYNLSHSYAVDAANHCGTVANGVLQTFMRMAWGGSYIALDSGHGRWDCIMTSYQYLIIQNTTWEDHCLFSRPSPIGYLGLLSQRTRDIYISRRLLGTFTWTLSDSEGRDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPRCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 72 - protein, 491 aa, Artificial Sequence
  derived and/or modified protein sequence (wt) from Lassa virus__AIT17340__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNISIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGEWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPRPHRLNHMGICSCGLYKQPGVPVKWKR

SEQ ID NO: 73 - protein, 491 aa, Artificial Sequence
  derived and/or modified protein sequence (wt) from Lassa virus__AIT17344__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYNHALMSIISTFHLSIPNFNQYEAMSCDFNGGKISVQYNLSHSYAGDAASHCGTVANGVLQTFMRMAWGGSYIALDSGYGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKTEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVRWKR

SEQ ID NO: 74 - protein, 491 aa, Artificial Sequence
  derived and/or modified protein sequence (wt) from Lassa virus__AIT17348__GPC
MGQIVTFFQEVPHVIEEVMNIVLIALSILAVLKGLYNIATCGLIGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGRWDCIMTSYQYLIIQNTTWEDHCQFSRPSPIGYLGLLSQRTRDIYISRRLLGTFTWTLSDSEGNDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 75 - protein, 491 aa, Artificial Sequence
  derived and/or modified protein sequence (wt) from Lassa virus__AIT17350__GPC
MGQIVTFFQEVPHVIEEVMNIVLIALSILAVLKGLYNVATCGLIGLVTFLLLCGRSCTTTLYKGVYELQALELNMETLNMTMPLSCTKNNSHHYIMVGNETGLELTLTNTSIIDHKFCNLSDAHKKNLYDHALMSIISTFHLSIPNFNQYEAMSCDFNGGKISVQYNLSHSYAGDAAKHCGTVANGVLQTFMRMAWGGSYIALDSGRNGWDCVMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKTEAQMSIQLINKAVNALINDQLIMKNHLRDIMGIPYCNYSKYWYLNHTVTGKTSLPRCWLVSNGSYLNETHFSDDIEQQADNMITEMLQKEYIERQGKTPLGLVDLFVFSTSFYLISIFLHLVKIPTHRHIIGKPCPKPHRLNHMGICSCGLYKQPGVPVRWKR

SEQ ID NO: 76 - protein, 491 aa, Artificial Sequence
  derived and/or modified protein sequence (wt) from Lassa virus__AIT17354__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNISIINHKFCNLSDAHKKNLYDHALMSIISTFHLSIPNFNQYEAMSCDFNGGKISVQYNLSHSYAGDAANHCGTVANGVLQTFMRMAWGGSYIALDSGHGGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPRPHRLNHMGICSCGLYKQPGVPVKWKR

SEQ ID NO: 77 - protein, 491 aa, Artificial Sequence
  derived and/or modified protein sequence (wt) from Lassa virus__AIT17360__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIRVGNETGLELTLTNTSIINHRFCNLSDAHKKNLYDHALMSIISTFHLSIPNFNQYEAMSCDFNGGKISVQYNLSHSYAGDAANHCGTVANGVLQTFMRMAWGGSYIALDSGHGKWDCIMTSYQYLIIQNTTWDDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTTTGKTSLPRCWLVSNGSYLNETHFSDDIEQQADNMITEMLQKEYMERQGKTPLGLVDLFVFSTSFYLISIFLHLVKIPTHRHIVGKSCPKPHRLNHMGICSCGFYKQPGVPVKWKR

SEQ ID NO: 78 - protein, 491 aa, Artificial Sequence
  derived and/or modified protein sequence (wt) from Lassa virus__AIT17364__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYIERQGKTPLGLVDLFVFSTSFYLISIFLHLVKIPTHRHIVGKPCPKPHRLNHMGICSCGLYKQPGVSVKWKR

SEQ ID NO: 79 - protein, 491 aa, Artificial Sequence
  derived and/or modified protein sequence (wt) from Lassa virus__AIT17368__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQFEAMSCDFNGGKISVQYNLSHSYAGDAANHCGTVANGVLQTFMRMAWGGSYIALDSGHSKWDCIMTSYQYLIIQNTTWDDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNYMGICSCGFYKQPGVPVKWKR

SEQ ID NO: 80 - protein, 491 aa, Artificial Sequence
  derived and/or modified protein sequence (wt) from Lassa virus__AIT17370__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVSVKWKR

SEQ ID NO: 81 - protein, 491 aa, Artificial Sequence
  derived and/or modified protein sequence (wt) from Lassa virus__AIT17378__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIINHKFCNLSDAHKKNLYDHTLMSIISTFHLSIPNFNQYEAMSCDFNGGKISVQYNLSHSYAVDAANHCGTVANGVLQTFMRMAWGGSYIALDSGRSGWDCIMTSYQYLVIQNTTWEDHCQFSRPSPIGYLGLLSQRTRDIYISRRLLGTFTWTLSDSEGKNTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGRTSLPRCWLVSNGSYLNETHFSDDIEQQADNMITEMLQKEYMERQGKTPLGLVDLFVFSTSFYLISIFLHLVKIPTHRHIVGKSCPKPHRLNHMGICSCGFYKQPGVPVKWKR

SEQ ID NO: 82 - protein, 491 aa, Artificial Sequence
  derived and/or modified protein sequence (wt) from Lassa virus__AIT17388__GPC
MGQIVTFFQEVPHVIEEVMNIVLIALSILAVLKGLYNVATCGLIGLVTFLLLCGRSCTTTLYKGVYELQALELNMETLNMTMPLSCTKNNSHHYIRVGNETGLELTLTNTSIINHKFCNLSDAHKKNLYDHALMSIISTFHLSIPNFNQYEAMSCDFNGGIISVQYNLSHSYAGDAANHCGTVANGVLQTFMRMAWGGSYIALDSGRNGWDCIMTSYQYLIIQNTTWDDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKTEAQMNIQLINKAVNALINDQLIMKNHLRDIMGIPYCNYSKYWYLNNTATGKTSLPRCWLVSNGSYLNETHFSDDIEQQADNMITEMLQKEYMERQGKTPLGLVDLFVFSTSFYLISIFLHLVKIPTHRHIVGKPCPKPHRLNHIGICSCGLYKQPGVPVKWKR

SEQ ID NO: 83 - protein, 490 aa, Artificial Sequence
  derived and/or modified protein sequence (wt) from Lassa virus__AIT17404__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLIKIPTHRHITGKPCPKPHRLNHMGICSCGLYKHPGVPVKWKR

SEQ ID NO: 84 - protein, 490 aa, Artificial Sequence
  derived and/or modified protein sequence (wt) from Lassa virus__AIT17408__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTVANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 85 - protein, 490 aa, Artificial Sequence
  derived and/or modified protein sequence (wt) from Lassa virus__AIT17412__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTSWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 86 - protein, 490 aa, Artificial Sequence
  derived and/or modified protein sequence (wt) from Lassa virus__AIT17416__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHRKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTSWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 87 - protein, 490 aa, Artificial Sequence
  derived and/or modified protein sequence (wt) from Lassa virus__AIT17420__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLIKIPTHRHITGKPCPKPHRLNHMGICSCGLYKHPGVPVKWKR

SEQ ID NO: 88 - protein, 490 aa, Artificial Sequence
  derived and/or modified protein sequence (wt) from Lassa virus__AIT17424__GPC
MGQIITFFQEVPHVIEEVMNIVLIALSLLAILKGIYNVATCGLFGLVSFLLLCGRSCSTTYKGVYELQTLELDMTNLNMTMPLSCTKNNSHHYIMVGNETGLELTLTNTSIINHKFCNLSDAHKKNLYNHALMSIISTFHLSIPNFNQYEAMSCDFNGGKISVQYNLSHAYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQTNIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHIIGKPCPKPHRLNHMGICSCGLYKHPGVPVKWKR

SEQ ID NO: 89 - protein, 490 aa, Artificial Sequence
  derived and/or modified protein sequence (wt) from Lassa virus__AIT17428__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIAADLKCFGNTAVAKCNEKHDEEFCDMLRLFDFNKQAIERLKTEAQMSIQLINKAVNALINDQLIMKNHLRDIMGIPYCNYSKYWYLNHTVTGRTSLPRCWLVSNGSYLNETHFSDDIEQQADNMITELLQKEYMDRQGKTPLGLVDLFVFSTSFYLISIFLHLVRIPTHRHVIGKPCPKPHRLNHMGICSCGLYKHPGVPVKWKR

SEQ ID NO: 90 - protein, 490 aa, Artificial Sequence
  derived and/or modified protein sequence (wt) from Lassa virus__AIT17430__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGRISVQYNLSHTYAVDAAKHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 91 - protein, 490 aa, Artificial Sequence
  derived and/or modified protein sequence (wt) from Lassa virus__AIT17438__GPC
MGQIITFFQEVPHVIEEVMNIVLIALSLLAILKGIYNVATCGLFGLVSFLLLCGRSCSTTYKGVYELQTLELDMANLNMTMPLSCTKNNSHHYIRVGNETGLELTLTNTSIISHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGKETPGGYCLTRWMLIEAELKCFGNTAVAKCNEKHDEEFCDMLRLFDFNKQAIRRLKTEAQMNIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNQMGICSCGLYKQPGVPVKWKR

SEQ ID NO: 92 - protein, 490 aa, Artificial Sequence
  derived and/or modified protein sequence (wt) from Lassa virus__AIT17442__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHRKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTSWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRINHMGICSCGLYKHPGVPVKWKR

SEQ ID NO: 93 - protein, 490 aa, Artificial Sequence
  derived and/or modified protein sequence (wt) from Lassa virus__AIT17446__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAASHCGTVANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 94 - protein, 490 aa, Artificial Sequence
  derived and/or modified protein sequence (wt) from Lassa virus__AIT17450__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHIIGKPCPKPHRLNHMGICSCGLYKHPGVPVKWKR

SEQ ID NO: 95 - protein, 490 aa, Artificial Sequence
  derived and/or modified protein sequence (wt) from Lassa virus__AIT17454__GPC
MGQIITFFQEVPHVIEEVMNIVLIAFSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKRNLYDHALMSIISTFHLSIPNFNQYEAMSCDFNGGKISVQYNLSHTYAVDAAGHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTITGKTSLPRCWLVSNGSYLNETHFSDDIEQQADNMITELLQKEYMDRQGKTPLGLVDLFVFSTSFYLISIFLHLVKIPTHRHIIGKPCPKPHRLNHMGICSCGLYKHPGVPVRWKR

SEQ ID NO: 96 - protein, 490 aa, Artificial Sequence
  derived and/or modified protein sequence (wt) from Lassa virus__AIT17458__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAIDAANHCGTIANGVLQTFMRMAWGGSYIALDSGKGSWDCIMTTYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 97 - protein, 490 aa, Artificial Sequence
  derived and/or modified protein sequence (wt) from Lassa virus__AIT17462__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPKCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 98 - protein, 490 aa, Artificial Sequence
  derived and/or modified protein sequence (wt) from Lassa virus__AIT17466__GPC
MGQIITFFQEVPQVIEEVMNIVLIALSLLAILKGIYNVATCGLFGLVSFLLLCGRSCSTTYKGVYELQTLELDMASLNMTMPLSCTKNNSHHYIMVGNETGLELTLTNQSIINHKFCNLSDAHKKNLYDHALMSIISTFHLSIPNFNQYEAMSCDFNGGKISVQYNLSHTFAVDAANHCGTIANGVLQTFMRMAWGGSYIALDSGRGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTITGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 99 - protein, 490 aa, Artificial Sequence
  derived and/or modified protein sequence (wt) from Lassa virus__AIT17470__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHRKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 100 - protein, 490 aa, Artificial Sequence
  derived and/or modified protein sequence (wt) from Lassa virus__AIT17474__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISIQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTITGKTSLPRCWLVSNGSYLNETHFSDDIEQQADNMITELLQKEYIDRQGKTPLGLVDLFVFSTSFYLISIFLHLVKIPTHRHITGKPCPKPHRLNHMGICSCGLYKHPGVPVRWKR

SEQ ID NO: 101 - protein, 490 aa, Artificial Sequence
  derived and/or modified protein sequence (wt) from Lassa virus__AIT17478__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAADHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAISRLKTEAQMSIQLINKAVNALINDQLIMKNHLRDIMGIPYCNYSKYWYLNHTVTGKTSLPRCWLVSNGSYLNETHFSDDIEQQADNMITEMLQKEYIDRQGKTPLGLVDLFVFSTSFYLISIFLHLVKIPTHRHVIGKPCPKPHRLNHMGICSCGLYKHPGVPVKWKR

SEQ ID NO: 102 - protein, 490 aa, Artificial Sequence
  derived and/or modified protein sequence (wt) from Lassa virus__AIT17482__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNITWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVVGKPCPKPHRLNHMGICSCGLYKHPGVPVKWKR

SEQ ID NO: 103 - protein, 490 aa, Artificial Sequence
  derived and/or modified protein sequence (wt) from Lassa virus__AIT17486__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPVGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 104 - protein, 490 aa, Artificial Sequence
  derived and/or modified protein sequence (wt) from Lassa virus__AIT17490__GPC
MGQIITFFQEVPHVIEEVMNIVLITLSLLAILKGIYNVATCGLFGLVSFLLLCGRSCSTTYKGVYELQTLELDMANLNMTMPLSCTKNNSHHYIMVGNETGLELTLTNTSIINHKFCNLSDAHKKNLYDHALMSIISTFHLSIPNFNQYEAMSCDFNGGKISVQYNLSHTFAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHIIGKPCPKPHRLNHMGICSCGLYKHPGVPVKWKR

SEQ ID NO: 105 - protein, 490 aa, Artificial Sequence
  derived and/or modified protein sequence (wt) from Lassa virus__AIT17494__GPC
MGQIITFFQEVPHVIEEVMNIVLIALSLLAILKGVYNVATCGLFGLVSFLLLCGRSCSTIYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTSWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 106 - protein, 490 aa, Artificial Sequence
  derived and/or modified protein sequence (wt) from Lassa virus__AIT17498__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNETPGGYCLTRWMLIETELKCFGNTAVAKCNEKHDEEFCDMLRLFDFNKQAISRLRSEAQMSIQLINKAVNALINDQLIMKNHLRDIMGIPYCNYSKYWYLNHTVTGKTSLPKCWLVSNGSYLNETHFSDDIEQQADNMITEMLQKEYIDRQGKTPLGLVDLFVFSTSFYLISIFLHLVKIPTHRHITGKPCPKPHRLNHMGICSCGLYKHPGVPVKWKR

SEQ ID NO: 107 - protein, 490 aa, Artificial Sequence
  derived and/or modified protein sequence (wt) from Lassa virus__AIT17502__GPC
MGQIITFFQEIPHVIEEVMNIVLITLSLLAILKGIYNVATCGLFGLVSFLLLCGKSCSTTYKGVYELQTLELDMASLNMTMPLSCTKNNSHHYIMVGNETGLELTLTNTSIINHKFCNLSDAHRKNLYDHTLMSIISTFHLSIPNFNQYEAMSCDFNGGKISVQYNLSHAYAIDAATHCGTIANGVLQTFMRMAWGGSYIALDSGKGGWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMRNHLRDIMGIPYCNYSKYWYLNHTVTGKTSLPKCWLVSNGSYLNETHFSDDIEQQADNMITELLQKEYMDRQGKTPLGLVDLFVFSTSFYLISIFLHLVKIPTHRHVIGKPCPKPHRLNHMGVCSCGLYKHPGVPVKWKR

SEQ ID NO: 108 - protein, 490 aa, Artificial Sequence
  derived and/or modified protein sequence (wt) from Lassa virus__AIT17506__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAAEHCGTIANGVLQTFMRMAWGGSYIALDSGKGSWDCVMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIERLKTEAQMSIQLINKAVNALINDQLIMKNHLRDIMGIPYCNYSKYWYLNHTVTGKTSLPRCWLVSNGSYLNETHFSDDIEQQADNMITEMLQKEYIDRQGKTPLGLVDLFVFSTSFYLISIFLHLVKIPTHRHVIGKPCPKPHRLNHMGICSCGLYKHPGVPVKWKR

SEQ ID NO: 109 - protein, 490 aa, Artificial Sequence
  derived and/or modified protein sequence (wt) from Lassa virus__AIT17510__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTKDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 110 - protein, 490 aa, Artificial Sequence
  derived and/or modified protein sequence (wt) from Lassa virus__AIT17514__GPC
MGQIITFFQEVPHVIEEVMNIVLIALSLLAVLKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYRHPGVPVKWKR

SEQ ID NO: 111 - protein, 490 aa, Artificial Sequence
  derived and/or modified protein sequence (wt) from Lassa virus__AIT17518__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 112 - protein, 490 aa, Artificial Sequence
  derived and/or modified protein sequence (wt) from Lassa virus__AIT17524__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAIDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITEMLQKEYMDRQGKTPLGLVDLFVFSTSFYLISIFLHLVKIPTHRHVIGKPCPKPHRLNHMGICSCGLYKHPGVPVKWKR

SEQ ID NO: 113 - protein, 490 aa, Artificial Sequence
  derived and/or modified protein sequence (wt) from Lassa virus__AIT17528__GPC
MGQIITFFQEVPHVIEEVMNIVLIALSLLAMLKGIYNIATCGLFGLISFLLLCGRSCSTTYKGVYELQALELDMANLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAGDAAKHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHSVTGRTSLPRCWLVSNGSYLNETQFSDDIEQQADNMITEMLQKEYIDRQGKTPLGLVDLFVFSTSFYLISIFLHLIKIPTHRHIVGKPCPKPHRLNHMGICSCGLYKHPGIPVKWKR

SEQ ID NO: 114 - protein, 490 aa, Artificial Sequence
  derived and/or modified protein sequence (wt) from Lassa virus__AIT17538__GPC
MGQIITFFQEVPHVIEEVMNIVLIALSLLAILKGIYNIATCGLFGLISFLLLCGRSCSTTYKGVYELQTLELDMANLNMTMPLSCTKNNSHHYIMVGNETGLELTLTNTSIINHKFCNLSDAHKKNLYDHALMSIISTFHLSIPNFNQYEAMSCDFNEGKISVQYNLSHSYAIDAAGHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNEAPGGYCLTRWMLIEAELKCFGNTAIAKCNEKHDEEFCDMLRLFDFNKQAIKRLKAEAQMSIHLINKAVNALINDQLIMKNHLRDIMGIPYCNYSKYWYLNHTVTGKTSLPKCWLVSNGSYLNETHFSDDIEQQADNMITELLQKEYMDRQGKTPLGLVDLFVFSTSFYLISIFLHLVKIPTHRHIVGRPCPKPHRLNHMGICSCGLYKHPGVPVKWKR

SEQ ID NO: 115 - protein, 490 aa, Artificial Sequence
  derived and/or modified protein sequence (wt) from Lassa virus__AIT17540__GPC
MGQIVTFFQEVPHVIEEIMNIVLITLSLLAILKGIYNFATCGLIGLITFLFLCGRSCSTIYKGSYQLQTLELNMETLNMTMPLSCTKNNSHHYIRVGNETGLELTLTNTSIINHKFCNLSEAHKKNLYDHALMSIISTFHLSIPNFNQYEAMSCDFNGGKISVQYNLSHSYAVDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGKETPGGYCLTRWMLIEAELKCFGNTAVAKCNEKHDEEFCDMLRLFDFNKQAIQRLKTEAQMSIQLINKAVNALINDQLIMKNHLRDIMGIPYCNYSKYWYLNHTSTGRTSLPKCWLVSNGSYLNETHFSDDIEQQADNMITEMLQKEYIDRQGKTPLGLVDLFVFSTSFYLISIFLHLVKIPTHRHIVGKSCPKPHRLNHMGICSCGLYKQPGVPVKWKR

SEQ ID NO: 116 - protein, 490 aa, Artificial Sequence
  derived and/or modified protein sequence (wt) from Lassa virus__AIT17544__GPC
MGQIITFFQEVPHVIEEVMNIVLIALSLLAILKGIYNVATCGLFGLVSFLLLCGRSCSTTYKGVYELQTLELDMGSLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHIIGKPCPKPHRLNHMGICSCGLYKHPGVPVKWKR

SEQ ID NO: 117 - protein, 490 aa, Artificial Sequence
  derived and/or modified protein sequence (wt) from Lassa virus__AIT17548__GPC
MGQIITFFQEVPHVIEEVMNIVLIALSLLAILKGIYNVATCGLFGLVSFLFLCGRSCSTTYKGVYELQTLELDMASLNMTMPLSCTKNNSHHYIMVGNETGLELTLTNTSIINHKFCNLSDAHKRNLYDHALMSIISTFHLSIPNFNQYEAMSCDFNGGKISVQYNLSHAYAGDAAKHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLRTEAQMSIQLINKAVNALINDQLIMKNHLRDIMGIPYCNYSKYWYLNHTVTGKTSLPKCWLVSNGSYLNETHFSDDIEQQADNMITEMLQKEYIDRQGKTPLGLVDLFVFSTSFYLISIFLHLVKIPTHRHVIGKPCPKPHRLNHMGICSCGLYKHPGVPVKWKR

SEQ ID NO: 118 - protein, 490 aa, Artificial Sequence
  derived and/or modified protein sequence (wt) from Lassa virus__AIT17552__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVNAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKK

SEQ ID NO: 119 - protein, 490 aa, Artificial Sequence
  derived and/or modified protein sequence (wt) from Lassa virus__AIT17556__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGRGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTITGKTSLPRCWLVSNGSYLNETHFSDDIEQQADNMITELLQKEYIDRQGKTPLGLVDLFVFSTSFYLISIFLHLVKIPTHRHITGKPCPKPHRLNHMGICSCGLYKHPGVPVRWKR

SEQ ID NO: 120 - protein, 490 aa, Artificial Sequence
  derived and/or modified protein sequence (wt) from Lassa virus__AIT17560__GPC
MGQIITFFQEVPHVIEEVMNIVLIALSLLAVLKGIYNVATCGLFGLVSFLLLCGRSCSTTYKGVYELQTLELDMASLNMTMPLSCTTNNSHHYIMVGNETGLELTLTNTSIINHKFCNLSDAHKKNLYDHALMSIISTFHLSIPNFNQYEAMSCDFNGGKISVQYNLSHAYAGEAANHCGTIANGVLQTFMRMAWGGSYIALDSGKGSWDCIMTSYKYLIIQNTTWGDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRKLKTEAQMSIQLINKAVNALINDQLIMKNHLRDIMGIPYCNYSRYWYLNHTVTGRTSLPRCWLVSNGSYLNETHFSDDIEQQADNMITELLQKEYIDRQGKTPLGLVDLFVFSTSFYLISIFLHLVKIPTHRHIIGKPCPKPHRLNHMGICSCGLYKHPGVPVKWKR

SEQ ID NO: 121 - protein, 490 aa, Artificial Sequence
  derived and/or modified protein sequence (wt) from Lassa virus__AIT17564__GPC
MGQIITFFQEVPHVIEEVMNIVLIALSLLAILKGIYNVATCGLFGLLSFLLLCGRSCSTTYKGVYELQTLELDMASLNMTMPLSCTKNNSHHYIMVGNETGLELTLTNTSIINHKFCNLSDAHKKDLYDHALMSIISTFHLSIPNFNQYEAMSCDFNGGKISVQYNLSHAYAVDAAKHCGTIANGVLQTFMRMAWGGSYIALDSGKGSWDCIMTSYQYLIIQNTSWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIKRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 122 - protein, 490 aa, Artificial Sequence
  derived and/or modified protein sequence (wt) from Lassa virus__AIT17572__GPC
MGQIITFFQEVPHVIEEVMNIVLIALSLLAILKGIYNVATCGLFGLVSFLLLCGRSCSTTYKGVYELQTLELDMANLNMTMPLSCTKNNSHHYIMVGNETGLELTLTNTSIINHKFCNLSDAHKKNLYDHALMSIISTFHLSIPNFNQYEAMSCDFNGGKISVQYNLSHNYAVDAANHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNDMPGGYCLTRWMLIEAELKCFGNTAVAKCNEKHDEEFCDMLRLFDFNKQAIRRLKTEAQMNIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHIIGKPCPKPHRLNHMGICSCGLYKHPGVPVKWKR

SEQ ID NO: 123 - protein, 490 aa, Artificial Sequence
  derived and/or modified protein sequence (wt) from Lassa virus__AIT17576__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAISRLKTEAQMSIQLINKAVNALINDQLIMKNHLRDIMGIPYCNYSKYWYLNHTVTGKTSLPRCWLVSNGSYLNETHFSDDIEQQADNMITEMLQKEYIDRQGKTPLGLVDLFVFSTSFYLISIFLHLVKIPTHRHITGKPCPKPHRLNHMGICSCGLYKHPGVPVKWKR

SEQ ID NO: 124 - protein, 490 aa, Artificial Sequence
  derived and/or modified protein sequence (wt) from Lassa virus__AIT17580__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSESNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTVTGRTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 125 - protein, 490 aa, Artificial Sequence
  derived and/or modified protein sequence (wt) from Lassa virus__AIT17584__GPC
MGQIITFFQEVPQVIEEVMNIVLIALSLLAILKGIYNVATCGLFGLVSFLLLCGRSCSTTYKGVYELQTLELDMASLNMTMPLSCTKNNSHHYIMVGNETGLELTLTNQSIINHKFCNLSDAHKKNLYDHALMSIISTFHLSIPNFNQYEAMSCDFNGGKISVQYNLSHSFAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTKTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 126 - protein, 490 aa, Artificial Sequence
  derived and/or modified protein sequence (wt) from Lassa virus__AIT17588__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 127 - protein, 490 aa, Artificial Sequence
  derived and/or modified protein sequence (wt) from Lassa virus__AIT17592__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHTLMSIISTFHLSIPNFNQYEAMSCDFNGGRISVQYNLSHAYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTITGKTSLPRCWLVSNGSYLNETHFSDDIEQQADNMITELLQKEYIDRQGKTPLGLVDLFVFSTSFYLISIFLHLVKIPTHRHVVGKPCPKPHRLNHMGICSCGLYKHPGVPVKWKR

SEQ ID NO: 128 - protein, 490 aa, Artificial Sequence
  derived and/or modified protein sequence (wt) from Lassa virus__AIT17596__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTSWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 129 - protein, 490 aa, Artificial Sequence
  derived and/or modified protein sequence (wt) from Lassa virus__AIT17600__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAGDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 130 - protein, 490 aa, Artificial Sequence
  derived and/or modified protein sequence (wt) from Lassa virus__AIT17604__GPC
MGQIITFFQEVPHVIEEVMNIVLIALSLLAILKGIYNVATCGLFGLVSFLLLCGRSCSTTYKGVYELQTLELDMTSLNMTMPLSCTKNNSHHYIMVGNETGLELTLTNTSIINHKFCNLSDAHKKDLYDHALMSIISTFHLSIPNFNQYEAMSCDFNGGKISVQYNLSHTYAVDAAKHCGTIANGVLQTFMRMAWGGSYIALDSGKGSWDCIMTSYQYLIIQNTTWEDHCQFSRPSPVGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYLDRQGKTPLGLVDLFVFSTSFYLISIFLHLVKIPTHRHVIGKPCPKPHRLNHMGICSCGLYKHPGVPVKWKR

SEQ ID NO: 131 - protein, 490 aa, Artificial Sequence
  derived and/or modified protein sequence (wt) from Lassa virus__AIT17608__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKRNLYNHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHIIGKPCPKPHRLNHMGICSCGLYKHPGVPVKWRR

SEQ ID NO: 132 - protein, 490 aa, Artificial Sequence
  derived and/or modified protein sequence (wt) from Lassa virus__AIT17612__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIRVGNETGLELTLTNTSIINHKFCNLSDAHKKNLYDHSLMSIISTFHLSIPNFNQYEAMSCDFNGGKISVQYNLSHTYAVDAANHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVVGKPCPKPHRLNHMGICSCGLYKHPGVPVKWKR

SEQ ID NO: 133 - protein, 490 aa, Artificial Sequence
  derived and/or modified protein sequence (wt) from Lassa virus__AIT17616__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 134 - protein, 490 aa, Artificial Sequence
  derived and/or modified protein sequence (wt) from Lassa virus__AIT17620__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIISHKFCNLSDAHKKNLYDHALMSIISTFHLSIPNFNQYEAMSCDFNGGKISVQYNLSHAYAIDAANHCGTVANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 135 - protein, 490 aa, Artificial Sequence
  derived and/or modified protein sequence (wt) from Lassa virus__AIT17626__GPC
MGQIITFFQEVPHVIEEVMNIVLIALSLLAILKGVYNVATCGLFGLVSFLLLCGRSCSTTYKGVYELQTLELDMASLNMTMPLSCTKNNSHHYIMVGNETGLELTLTNTSIIQHKFCNLSDAHKKNLYDHALMSIISTFHLSIPNFNQYEAMSCDFNGGKITVQYNLSHSYAIDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGRTSLPRCWLVSNGSYLNETHFSDDIEQQADNMITELLQKEYMDRQGKTPLGLVDLFVFSTSFYLISIFLHLVKIPTHRHIIGKPCPKPHRLNHMGVCSCGLYKHPGVPVKWKR

SEQ ID NO: 136 - protein, 490 aa, Artificial Sequence
  derived and/or modified protein sequence (wt) from Lassa virus__AIT17630__GPC
MGQIITFFQEVPHVIEEVMNIVLIALSLLAILKGIYNVATCGLFGLLSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAAEHCGTIANGVLQTFMRMAWGGSYIALDSGKGSWDCVMTSYQYLIIQNTSWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 137 - protein, 490 aa, Artificial Sequence
  derived and/or modified protein sequence (wt) from Lassa virus__AIT17634__GPC
MGQIITFFQEVPHVIEEVMNIVLIALSLLAILKGIYNVATCGLFGLVSFLLLCGRSCSTIYKDVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAIDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSRYWYLNHTVTGRTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYNHPGVPVKWKR

SEQ ID NO: 138 - protein, 490 aa, Artificial Sequence
  derived and/or modified protein sequence (wt) from Lassa virus__AIT17638__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKDLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLIKIPTHRHITGKPCPKPHRLNHMGICSCGLYKHPGVPVKWKR

SEQ ID NO: 139 - protein, 490 aa, Artificial Sequence
  derived and/or modified protein sequence (wt) from Lassa virus__AIT17642__GPC
MGQIITFFQEVPHVIEEVMNIVLIALSLLAILKGVYNVATCGLFGLVSFLLLCGRSCSTTYKGVYELQTLELDMASLNMTMPLSCTKNNSHHYIMVGNDTGLELTLTNTSIINHKFCNLSDAHKKNLYDHALMSIISTFHLSIPNFNQYEAMSCDFNGGKISVQYNLSHAYAVDAASHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHIIGKPCPKPHRLNHMGICSCGLYKHPGVPVKWKR

SEQ ID NO: 140 - protein, 490 aa, Artificial Sequence
  derived and/or modified protein sequence (wt) from Lassa virus__AIT17646__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAASHCGTVANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 141 - protein, 490 aa, Artificial Sequence
  derived and/or modified protein sequence (wt) from Lassa virus__AIT17650__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNISIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTVTGRTSLPRCWLVSNGSYLNETHFSDDIEQQADNMITELLQKEYIDRQGKTPLGLVDLFVFSTSFYLISIFLHLVKIPTHRHIIGKPCPKPHRLNHMGICSCGLYKHPGVPVKWKR

SEQ ID NO: 142 - protein, 490 aa, Artificial Sequence
  derived and/or modified protein sequence (wt) from Lassa virus__AIT17658__GPC
MGQIITFFQEVPHVIEEVMNIVLIALSLLAILKGVYNVATCGLFGLVSFLLLCGRSCSITYKGVYELQTLELDMANLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAGDAADHCGTIANGVLQTFMRMAWGGSYIALDSGKGSWDCIMTSYQYLIIQNTTWEDHCQFSRPSPMGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTITGKTSLPRCWLVSNGSYLNETHFSDDIEQQADNMITELLQKEYIDRQGKTPLGLVDLFVFSTSFYLISIFLHLVKIPTHRHITGKPCPKPHRLNHMGICSCGLYKHPGVPVRWKR

SEQ ID NO: 143 - protein, 490 aa, Artificial Sequence
  derived and/or modified protein sequence (wt) from Lassa virus__AIT17666__GPC
MGQIVTFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHITGKPCPKPHRLNHMGICSCGLYKHPGVPVKWKR

SEQ ID NO: 144 - protein, 490 aa, Artificial Sequence
  derived and/or modified protein sequence (wt) from Lassa virus__AIT17670__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTVTGRTSLPRCWLVSNGSYLNETHFSDDIEQQADNMITELLQKEYIDRQGKTPLGLVDLFVFSTSFYLISIFLHLVKIPTHRHIIGKPCPKPHRLNHMGICSCGLYKHPGVPVKWKR

SEQ ID NO: 145 - protein, 490 aa, Artificial Sequence
  derived and/or modified protein sequence (wt) from Lassa virus__AIT17674__GPC
MGQIITFFQEVPHVIEEVMNIVLIALSLLAILKGIYNVATCGLFGLVSFLLLCGRSCSTTYKGVYELQTLELDMTNLNMTMPLSCTKNNSHHYIMVGNETGLELTLTNTSIINHKFCNLSDAHKKNLYNHALMSIISTFHLSIPNFNQYEAMSCDFNGGKISVQYNLSHSYAVDAANHCGTIANGVLQTFMRMAWGGSYIALDSGKGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQANIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 146 - protein, 490 aa, Artificial Sequence
  derived and/or modified protein sequence (wt) from Lassa virus__AIT17678__GPC
MGQIITFFQEVPHVIEEVMNIVLITLSLLAILKGIYNIATCGLFGLVSFLLLCGRSCSTTYKGVYELQTLELDMTSLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHIIGKPCPKPHRLNHMGICSCGLYKHPGIPVKWKR

SEQ ID NO: 147 - protein, 490 aa, Artificial Sequence
  derived and/or modified protein sequence (wt) from Lassa virus__AIT17686__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSRKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLIKIPTHRHVIGKPCPKPHRLNHMGICSCGLYKHPGVPVKWKR

SEQ ID NO: 148 - protein, 490 aa, Artificial Sequence
  derived and/or modified protein sequence (wt) from Lassa virus__AIT17690__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAASHCGTVANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGRTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 149 - protein, 490 aa, Artificial Sequence
  derived and/or modified protein sequence (wt) from Lassa virus__AIT17694__GPC
MGQIITFFQEVPHVIEEVMNIVLIALSLLAILKGIYNVATCGLFGLVSFLLLCGRSCSTIYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVVGKPCPKPHRLNHMGICSCGLYKHPGVPVKWKR

SEQ ID NO: 150 - protein, 490 aa, Artificial Sequence
  derived and/or modified protein sequence (wt) from Lassa virus__AIT17712__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGAWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIMRLKTEAQMSIQLINKAVNALINDQLIMKNHLRDIMGIPYCNYSKYWYLNHTVTGKTSLPRCWLVSNGSYLNETHFSDDIEQQADNMITEMLQKEYIDRQGKTPLGLVDLFVFSTSFYLISIFLHLVKIPTHRHVIGKPCPKPHRLNHMGICSCGLYKHPGVPVRWKR

SEQ ID NO: 151 - protein, 490 aa, Artificial Sequence
  derived and/or modified protein sequence (wt) from Lassa virus__AIT17718__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIRVGNETGLELTLTNASIINHKFCNLSDAHKKNLYDHALMSIISTFHLSIPNFNQYEAMSCDFNGGKISVQYNLSHAYAIDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGFYKHPGVPVKWKR

SEQ ID NO: 152 - protein, 490 aa, Artificial Sequence
  derived and/or modified protein sequence (wt) from Lassa virus__AIT17724__GPC
MGQIITFFQEVPHVIEEVMNIVLIALSLLAILKGIYNVATCGLFGLVSFLLLCGRSCSTTYKGVYELQTLELDMANLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTVANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHIMGKPCPKPHRLNHMGICSCGLYKHPGVPVKWKR

SEQ ID NO: 153 - protein, 490 aa, Artificial Sequence
  derived and/or modified protein sequence (wt) from Lassa virus__AIT17728__GPC
MGQIITFFQEVPHVIEEVMNIVLIALSLLAILKGIYNVATCGLFGLVSFLLLCGRSCSTTYKGVYELQTLELDMGSLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 154 - protein, 490 aa, Artificial Sequence
  derived and/or modified protein sequence (wt) from Lassa virus__AIT17732__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHIVGKPCPKPHRLNHMGICSCGLYKHPGVPVKWKR

SEQ ID NO: 155 - protein, 490 aa, Artificial Sequence
  derived and/or modified protein sequence (wt) from Lassa virus__AIT17736__GPC
MGQIVTFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKDLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIMRLKTEAQMSIQLINKAVNALINDQLIMKNHLRDIMGIPYCNYSKYWYLNHTVTGKTSLPRCWLVSNGSYLNETRFSDDIEQQADNMITEMLQKEYLDRQGKTPLGLVDLFVFSTSFYLISIFLHLVKIPTHRHIIGKPCPKPHRLNHMGICSCGLYKHPGVPVKWKR

SEQ ID NO: 156 - protein, 490 aa, Artificial Sequence
  derived and/or modified protein sequence (wt) from Lassa virus__AIT17744__GPC
MGQIITFFQEVPHVIEEVMNIVLIALSLLAILKGIYNVATCGLFGLMSFLLLCGRSCSTTYKGVYELQTLELDMANLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAVDAANHCGTIANGVLQTFMRMAWGGSYIALDSGKGSWDCIMTSYQYLIIQNTSWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 157 - protein, 490 aa, Artificial Sequence
  derived and/or modified protein sequence (wt) from Lassa virus__AIT17752__GPC
MGQIITFFHEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAIDAANHCGTIANGVLQTFMRMAWGGSYIALDSGRGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 158 - protein, 490 aa, Artificial Sequence
  derived and/or modified protein sequence (wt) from Lassa virus__AIT17756__GPC
MGQIITFFQEVPHVIEEVMNIVLIALSLLAILKGIYNVATCGLFGLVSFLLLCGRSCSITYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGRGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTVTGRTSLPRCWLVSNGSYLNETHFSDDIEQQADNMITELLQKEYIDRQGKTPLGLVDLFVFSTSFYLISIFLHLVKIPTHRHIIGKPCPKPHRLNHMGICSCGLYKHPGVPVKWKR

SEQ ID NO: 159 - protein, 490 aa, Artificial Sequence
  derived and/or modified protein sequence (wt) from Lassa virus__AIT17758__GPC
MGQIITFFQEVPHVIEEVMNIVLIALSLLAILKGIYNVATCGLFGLVSFLLLCGRSCSTTYKGVYELQTLELNMASLNMTMPLSCTKNNSHHYIMVGNETGLELTLTNTSIINHKFCNLSDAHKRNLYDHALMSIISTFHLSIPNFNQYEAMSCDFNGGKISVQYNLSHTYAVDAAKHCGTIANGVLQTFMRMAWGGSYIALDSGKGSWDCIMTSYQYLIIQNTTWEDHCEFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVKWKR

SEQ ID NO: 160 - protein, 490 aa, Artificial Sequence
  derived and/or modified protein sequence (wt) from Lassa virus__AIT17762__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIISHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNEAPGGYCLTRWMLIEAELKCFGNTAVAKCNEKHDEEFCDMLRLFDFNKQAIRRLKTEAQMSIQLINKAVNALINDQLIMKNHLRDIMGIPYCNYSRYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 161 - protein, 490 aa, Artificial Sequence
  derived and/or modified protein sequence (wt) from Lassa virus__AIT17770__GPC
MGQIVTFFQEVPHVIEEVMNIVLIALSLLAILKGIYNVATCGLFGLVSFLLLCGRSCSTTYKGVYELQALELDMSSLNMTMPLSCTKNNSHHYIMVGNETGLELTLTNTSIIHHKFCNLSDAHKKDLYDHALMSIISTFHLSIPNFNQYEAMSCDFNGGKISVQYNLSHTYAVDAANHCGTIANGVLQTFMRMAWGGSYIALDSGKGGWDCIMTSYQFLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIKRLKTEAQMSIHLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVIGKPCPKPHRLNHMGICSCGLYKHPGVPVRWKR

SEQ ID NO: 162 - protein, 490 aa, Artificial Sequence
  derived and/or modified protein sequence (wt) from Lassa virus__AIT17778__GPC
MGQIITFFQEVPHVIEEVMNIVLIALSLLAILKGIYNVATCGLFGLVSFLLLCGRSCSTTYKGVYELQTLELDMANLNMTMPLSCTKNNSHHYIMVGNETGLELTLTNTSIINHKFCNLSDAHKKNLYDHALMSIISTFHLSIPNFNQYEAMSCDFNGGKISVQYNLSHTYARDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMNIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHVIGKPCPKPHRLNHMGICSCGLYKHPGVPVKWKR

SEQ ID NO: 163 - protein, 490 aa, Artificial Sequence
  derived and/or modified protein sequence (wt) from Lassa virus__AIT17782__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIKRLKTEAQMSIQLINKAVNALINDQLIMKNHLRDIMGIPYCNYSKYWYLNHTVTGKTSLPRCWLVSNGSYLNETHFSDDIEQQADNMITELLQKEYIDRQGKTPLGLVDLFVFSTSFYLISIFLHLVKIPTHRHVVGKPCPKPHRLNHMGICSCGLYKHPGVPVKWKR

SEQ ID NO: 164 - protein, 490 aa, Artificial Sequence
  derived and/or modified protein sequence (wt) from Lassa virus__AIT17786__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHAYAIDAADHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHITGKPCPKPHRLNHMGICSCGLYKHPGVPVKWKR

SEQ ID NO: 165 - protein, 490 aa, Artificial Sequence
  derived and/or modified protein sequence (wt) from Lassa virus__AIT17790__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSKYWYLNHTVTGKTSLPRCWLVSNGSYLNETHFSDDIEQQADNMITELLQKEYMDRQGKTPLGLVDLFVFSTSFYLISIFLHLVKIPTHRHITGKPCPKPHRLNHMGICSCGLYKHPGVPVKWKR

SEQ ID NO: 166 - protein, 490 aa, Artificial Sequence
  derived and/or modified protein sequence (wt) from Lassa virus__AIT17798__GPC
MGQIITFFQEVPHVIEEVMNIVLIALSLLAILKGIYNVATCGLFGLVSFLLLCGRSCSTTYKGVYELQTLELDMASLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAVDAANHCGTIANGVLQTFMRMAWGGSYIALDSGKGSWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIMRLKTEAQMSIQLINKAVNALINDQLIMKNHLRDIMGIPYCNYSKYWYLNHTVTGKTSLPRCWLVSNGSYLNETHFSDDIEQQADNMITEMLQKEYLDRQGKTPLGLVDLFVFSTSFYLISIFLHLVKIPTHRHIIGKPCPKPHRLNHMGICSCGLYKHPGVPVKWKR

SEQ ID NO: 167 - protein, 491 aa, Artificial Sequence
  derived and/or modified protein sequence (wt) from Lassa virus__AIT17802__GPC
MGQIVTFFQEVPHVIEEVMNIVLIALSILAVLKGLYNLATCGLVGLVTFLLLCGRSCTTSLYKGVYELQTLELNMETLNMTMPLSCTKNNSHHYIMVGNETGLELTLTNTSIINHKFCNLSDAHKKNLYNHALMSIISTFHLSIPNFNQYEAMSCDFNGGKISVQYNLSHSYAGDAANHCGTVANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERLGKTPLGLVDLFVFSTSFYLISIFLHLVKIPTHRHIVGRSCPKPHRLNHMGICSCGLYKQPGVPVKWKR

SEQ ID NO: 168 - protein, 491 aa, Artificial Sequence
  derived and/or modified protein sequence (wt) from Lassa virus__AIT17806__GPC
MGQIVTFFQEVPHVIEEVMNIVLIALSILAVLKGLYNFATCGLIGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 169 - protein, 491 aa, Artificial Sequence
  derived and/or modified protein sequence (wt) from Lassa virus__AIT17810__GPC
MGQIVTFFQEVPHVIEEVMNIVLIALSILAVLKGLYNLATCGLVGLVTFLLLCGRSCTTSLYKGVYELQTLELNMETLNMTMPLSCTKDNSHHYIRVGNETGLELTLTNTSILNHKFCNLSDAHKKNLYDHALMSIISTFHLSIPNFNQYEAMSCDFNGGRISVQYNLSHSYAGDAANHCGTVANGVLQTFMRMAWGGSYIALDSGRGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPRCWLVSNGSYLNETHFSDDIEQQADNMITEMLQKEYMERQGKTPLGLVDLFVFSTSFYLISIFLHLVKIPTHRHVVGKPCPKPHRLNHMGICSCGLYKQPGVPVKWKR

SEQ ID NO: 170 - protein, 491 aa, Artificial Sequence
  derived and/or modified protein sequence (wt) from Lassa virus__AIT17814__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIIDHKFCNLSDAHRKNLYDHALMSIISTFHLSIPNFNQYEAMSCDFNGGKISVQYNLSHSYAKDAADHCGTVANGVLQTFMRMAWGGSYIALDSGRGRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 171 - protein, 491 aa, Artificial Sequence
  derived and/or modified protein sequence (wt) from Lassa virus__AIT17820__GPC
MGQIVTFFQEVPHVIEEVMNIVLIALSILAVLKGLYNFATCGLVGLVTFLLLCGRSCTTSLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAEDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 172 - protein, 491 aa, Artificial Sequence
  derived and/or modified protein sequence (wt) from Lassa virus__AIT17824__GPC
MGQIVTFFQEVPHVIEEVMNIVLIALSILAVLKGLYNFATCGLVGLVTFLLLCGRSCTTSVYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGHGKWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVRWKR

SEQ ID NO: 173 - protein, 491 aa, Artificial Sequence
  derived and/or modified protein sequence (wt) from Lassa virus__AIT17828__GPC
MGQIVTFFQEVPHVIEEVMNIVLIALSILAVLKGLYNFATCGLVGLVTFLLLCGRSCTTSLYKGDYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKSCPKPHRLNHMGICSCGLYKQPGVPVKWKR

SEQ ID NO: 174 - protein, 490 aa, Artificial Sequence
  derived and/or modified protein sequence (wt) from Lassa virus__AIT17836__GPC
MGQIITFFQEVPHVIEEVMNIVLIALSLLAILKGLYNIATCGIIGLVAFLFLCGKSCSLTLKGGYELQTLELNMETLNMTMPLSCTKNSSHHYIRVGNETGLELTLTNTSIINHKFCNLSDAHKKNLYDHALMSIISTFHLSIPNFNQYEAMSCDFNGGKISVQYNLSHSYAGDAAEHCGTVANGVLQTFMRMAWGGRYIALDSGKGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKAEAQMSIQLINKAVNALINDQLIMKNHLRDIMGIPYCNYSKYWYLNHTSSGRTSLPKCWLISNGSYLNETQFSDDIEQQADNMITEMLQKEYIERQGKTPLGLVDIFIFSTSFYLISIFLHLIKIPTHRHIVGKPCPKPHRLNHMGVCSCGLYKHPGVPTKWKR

SEQ ID NO: 175 - protein, 491 aa, Artificial Sequence
  derived and/or modified protein sequence (wt) from Lassa virus__AIT17840__GPC
MGQIVTFFQEVPHVIEEVMNIVLIALSILAVLKGLYNFATCGLVGLVTFLLLCGRSCTISLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 176 - protein, 491 aa, Artificial Sequence
  derived and/or modified protein sequence (wt) from Lassa virus__AIT17844__GPC
MGQIVTFFQEVPHVIEEVMNIVLIALSILAVLKGLYNFATCGLVGLVTFLLLCGRSCTISLYKGVYELQTLELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHSYAGDAANHCGTVANGVLQTFMRMAWGGSYIALDSGRDRWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINRAVNALINDQLIMKNHLRDIMGIPYCNYSKYWYLNHTTTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGLYKQPGVPVKWKR

SEQ ID NO: 177 - protein, 490 aa, Artificial Sequence
  derived and/or modified protein sequence (wt) from Lassa virus__AMR44577__GPC
MGQIITFFQEVPHVIEEVMNIVLIALSLLAILKGVYNVATCGIIGLVTFLFLCGRSCSLIYKGSYELQTLELNMETLNMTMPLSCTKNSSHHYIRVGNETGLELTLTNTSIINHKFCNLSDAHKRNLYDHALMSILSTFHLSIPNFNQYEAMSCDFNGGKISVQYNLSHAYAVDAAEHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIQRLKSEAQMSIQLINKAVNALINDQLIMKNHLRDMMGIPYCNYSKYWYLNHTSSGRTSLPKCWLVSNGSYLNETHFSDDIEQQADNMITEMLQKEYIDRQGKTPLGLVDLFVFSTSFYLISIFLHLIKIPTHRHIVGKPCPKPHRLNHMGICSCGLYKQPGVPTRWKR

SEQ ID NO: 178 - protein, 491 aa, Artificial Sequence
  derived and/or modified protein sequence (wt) from Lassa virus__ANH09722__GPC
MGQIVTFFQEVPHVIEEVMNIVLIALSILAVLKGLYNVATCGLIGLVTFLLLCGRSCTTTLYKGVYELQALELNMETLNMTMPLSCTKNNSHHYIRVGNETGLELTLTNTSLINHKFCNLSDAHKKNLYDHALMSIISTFHLSIPNFNQYEAMSCDFNDGKISVQYNLSHTYAGDTANHCGTVANGVLQTFMRMAWGGSYIALDSGRGGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTVTGKTSLPKCWLVSNGSYLNETHFSDDIEQQADNMITEMLQKEYMERQGKTPLGLVDLFVFSTSFYLISIFLHLVKIPTHRHVVGKPCPKPHRLNHMGICSCGFYKQPGVPVRWKR

SEQ ID NO: 179 - protein, 491 aa, Artificial Sequence
  derived and/or modified protein sequence (wt) from Lassa virus__ANH09724__GPC
MGQIVTFFQEVPHVIEEVMNIVLIALSILAVLKGLYNVATCGLIGLVTFLLLCGRSCTTTLYKGVYELQALELNMETLNMTMPLSCTKNDSHHYIMVGNETGLELTLTNTSIISHKFCNLSDAHKQNLYDHALMSIISTFHLSIPNFNQYEAMSCDFNGGKISVQYNLSHTYAGDAANHCGTVANGVLQTFMRMAWGGSYIALDSGRGGWDCIMTSYQYLIIQNTTWEDHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTVTGKTSLPKCWLVSNGSYLNETHFSDDIEQQADNMITEMLQKEYMERQGKTPLGLVDLFVFSTSFYLISIFLHLVKIPTHRHVVGKPCPKPHRLNHMGICSCGFYGQPGVPVRWKR

SEQ ID NO: 180 - protein, 491 aa, Artificial Sequence
  derived and/or modified protein sequence (wt) from Lassa virus__ANH09728__GPC
MGQIVTFFQEVPHVIEEVMNIVLIALSVLAVLKGLYNVATCGLIGLVTFLLLCGRSCTTTLYKGVYELQALELNMGTLNMTMPLSCTKNNSHHYIMVGNETGLELTLTNTSIINHKFCNLSDAHKKDLYDHALMSIISTFHLSVPNFNQYEAMSCDFNGGKISVQYNLSHAYAGDTANHCGTVANGVLQTFMRMAWGGSYIALDSGRGGWDCIMTSYQYLIIQNTTWEDHCQFSRPSPIGYLGLLSQRTRDIYISRRLLGTFTWTLSDSEGEYTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTVTGKTSLPKCWLVSNGSYLNETHFSDDIEQQADNMITEMLQKEYMERQGKTPLGLVDLFVFSTSFYLISIFLHLVKIPTHRHVVGKPCPKPHRLNHMGICSCGFYKQPGVPVRWKR

SEQ ID NO: 181 - protein, 491 aa, Artificial Sequence
  derived and/or modified protein sequence (wt) from Lassa virus__ANH09730__GPC
MGQIVTFFQEVPHVIEEVMNIVLIALSVLAVLKGLYNVATCGLIGLVTFLLLCGRSCTTTLYKGVYELQALELNMETLNMTMPLSCTKNNSHHYIMVGNETGLELTLTNTSIINHKFCNLSDAHKKNLYDHALMSIISTFHLSIPNFNQYEAMSCDFNQGKISVQYNLSHAYAGDAANHCGTVANGVLQTFMRMAWGGSYIALDSGRGGWDCIMTSYQYLIIQNTTWENHCQFSRPSPIGYLGLLSQRTRDIYISRRLLGTFTWTLSDSEGKGTPGGYCLTRWMLIEAELKCFGNTAVAKCNEKHDEEFCDMLRLFDFNKQAIQRFKAEAQMSIQLINKAVNALINDQLIMKNHLRDIMGIPYCNYSKYWYLNHTVTGKTSLPKCWLVSNGSYLNETHFSDDIEQQADNMITEMLQKEYMERQGRTPLGLVDLFVFSTSFYLISIFLHLVKIPTHRHVVGKPCPKPHRLNHMGICSCGFYKQPGVPVRWKR

SEQ ID NO: 182 - protein, 491 aa, Artificial Sequence
  derived and/or modified protein sequence (wt) from Lassa virus__ANH09732__GPC
MGQIVTFFQEVPHVIEEVMNIVLIALSILAVLKGVYNVATCGLIGLVTFLLLSGRSCTTTIYKGVYELQALELNMETLNMTMPLSCTKNNSHHYIMVGNETGLELTLTNTSIINHKFCNLSDAHKKNLYDHALMSIISTFHLSIPNFNQYEAMSCDFNGGKISVQYNLSHTYAGDAANHCGTVANGVLQTFMRMAWGGSYIALDSGHGGWDCIMTSYQYLIIQNTTWENHCQFSRPSPIGYLGLLSQRTRDIYISRRLLGTFTWTLSDSEGKDTPGGYCLTRWMLIEAELKCFGNTAVAKCNEKHDEEFCDMLRLFDFNKQAIQRLKAEAQMSIQLINKAVNALINDQLIMKNHLRDIMGIPYCNYSKYWYLNHTVTGKTSLPKCWLVSNGSYLNETHFSDDIEQQADNMITEMLQKEYMERQGKTPLGLVDLFVFSTSFYLISIFLHLVKIPTHRHIVGKPCPKPHRLNHMGICSCGFYKQPGVPVRWKR

SEQ ID NO: 183 - protein, 490 aa, Artificial Sequence
  derived and/or modified protein sequence (wt) from Lassa virus__ANH09738__GPC
MGQIVTFFQEVPHVIEEIMNIVLITLSLLAILKGLYNFATCGLIGLITFLFLCGRSCSMIYKGSYQLETLELNMETLNMTMPLSCTKNNSHHYIRVGNETGLELTLTNTSIINHKFCNLSDAHKRNLYDHSLMSIISTFHLSIPNFNQYEAMSCDFNGGKISIQYNLSHTYAGDAAKHCGTVANGVLQTFMRMAWGGSYIALDSGRGNWDCIMTSYQYLIIQNTTWEDHCQFSRPSPIGYLGLLSQRTRDIYISRRLLGTFTWTLSDSEGKETPGGYCLTRWMLIEAELKCFGNTAVAKCNEKHDEEFCDMLRLFDFNKQAIQRLKTEAQMSIQLINKAVNALINDQLIMKNHLRDIMGIPYCNYSKYWYLNHTSTGRTSLPKCWLVSNGSYLNETHFSDDIEQQADNMITEMLQKEYIDRQGKTPLGLVDVFMFSTSFYLISIFLHLVKIPTHRHIVGKSCPKPHRLNHMGICSCGLYKQPGVPVRWKR

SEQ ID NO: 184 - protein, 490 aa, Artificial Sequence
  derived and/or modified protein sequence (wt) from Lassa virus__ANH09740__GPC
MGQIVTFFQEVPHVIEEVMNIVLIALSLLAILKGLYNFATCGVIGLITFLLLCGRSCSATYKGQYELQTLELNMESLNMTMPLSCTKNNSHHYIRAGNNTGLELTLTNTSIISHKFCNLSDAHKKNLYDHTLMSIITTFHLSIPNFNQYEAMSCDFNGGKISIQYNLSHSYAGDAAQHCGTVANGVLQTFMRMAWGGSYLALDSGRRGWDCIISSYQYLIIQNTTWDDHCQFSRPSPIGYLGFVSQKTRDIYISRRLLGTFTWTLSDSEGHDMPGGYCLTRWMLIEADLKCFGNTAVAKCNEKHDEEFCDMWRLFDFNKQAIQRLKAEAQMNIQLINKAVNALINDQLMMKNHLRDIMGIPYCNYSKFWYLNNTTTGRTSLPRCWLISNGSYLNETHFSDDIEQQADNMITEMLQKEYMDRQGKTPLGLVDLFVFSTSFYLITIFLHLVKIPTHRHIVGKPCPKPHRLNHMGICSCGLYKQPGVPVRWKR

SEQ ID NO: 185 - protein, 490 aa, Artificial Sequence
  derived and/or modified protein sequence (wt) from Lassa virus__CAA36645__GPC
MGQIVTFFQEVPHVIEEVMNIVLIALSILAILKGLYNVATCGLIGLVTFLLLSGRSCSLIYKGTYELQTLELNMETLNMTMPLSCTKNNSHHYIRVGNETGLELTLTNTSILNHKFCNLSDAHKRNLYDHSLMSIISTFHLSIPNFNQYEAMSCDFNGGKITVQYNLSHSFAVDAAGHCGTLANGVLQTFMRMAWGGSYIALDSGRGNWDCIMTSYQYLIIQNTTWDDHCQFSRPSPIGYLGLLSQRTRDIYISRRLLGTFTWTLSDSEGNETPGGYCLTRWMLIEAELKCFGNTAVAKCNEKHDEEFCDMLRLFDFNKQAIRRLKTEAQMSIQLINKAVNALINDQLIMKNHLRDIMGIPYCNYSRYWYLNHTSTGKTSLPRCWLISNGSYLNETKFSDDIEQQADNMITEMLQKEYIDRQGKTPLGLVDLFVFSTSFYLISIFLHLVKIPTHRHIVGKPCPKPHRLNHMGICSCGLYKQPGVPVRWKR

SEQ ID NO: 186 - protein, 491 aa, Artificial Sequence; identical to SEQ ID NO: 6
  derived and/or modified protein sequence (wt) from Lassa virus__NP_694870__GPC

SEQ ID NO: 187 - protein, 570 aa, Artificial Sequence
  derived and/or modified protein sequence (wt) from Lassa virus__AAA46284__NP
MSASKEVRSCLWTQSLRRELSGYCSNIKLQVVKDAQALLHGLDFSEVSNVQRLMRKQKRDDGDLKRLRDLNQAVNNLVELKSTQQKSVLRVGTLSSDDLLILAADLEKLKSKVTRTERPLSSGVYMGNLSSQQLDQRRALLNMIGMTGVSGGGKGASNGIVRVWDVKNAELLNNQFGTMPSLTLACLTKQGQVDLNDAVQALTDLGLIYTAKYPNSSDLDRLSQSHPILNMIDTKKSSLNISGYNFSLGAAVKAGACMLDGGNMLETIKVSPQTMDGILKSILKVKKSLGMFVSDTPGERNPYENILYKICLSGDGWSYIASRTSIVGRAWENTVVDLEQDNKPQKIGNGGSNKSLQSAGFAAGLIYSQLMTLKDFKCFNLIPNAKTWMDIEGRPEDPVEIALYQPSSGCYVHFFREPTDLKQFKQDAKYSHGRDVTDLFAAQPGLTSAVIEALPRNMVITCQGSEDIRKLLESQGRRDIKLIDITLSKADSRKFENAVWDQFKDLCHMHTGVVVEKKKRGGKEEITPHCALMDCIMFDAAVSGGLDAKVLRVVLPRDMVFRTSTPKVVL

SEQ ID NO: 188 - protein, 569 aa, Artificial Sequence
  derived and/or modified protein sequence (wt) from Lassa virus__AAF86704__NP
MSASKEVKSFLWTQSLRRELSGYCSNIKLQVVKDAQALLHGLDFSEVNNVQRLMRKQKRDDGDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDISLSKVDSRKFENAVWDQCKDLCHMHTGVVVEKKKRGGKEEITPHCALMDCIMFDAAVSGGLNIPVLRAVLPRDMVFRTSSPKVVL

SEQ ID NO: 189 - protein, 569 aa, Artificial Sequence
  derived and/or modified protein sequence (wt) from Lassa virus__AAO59513__NP
MSASKEVKSFLWTQSLRRELSGYCSNIKLQVVKDAQALLHGLDFSEVSNVQRLMRKERRDDSDLKRLRDLNQAVNNLVELKSTQQKSVLRVGTLTSDDLLVLAADLEKLRSKVTRTERPLSAGVYMGNLSSQQLDQRRALLSMIGMNGSNQGARAGRDGVVRVWDVKNAELLNNQFGTMPSLTLACLTKQGQVDLNDAVQALTDLGLIYTAKYPNTSDLDRLTQSHPILNMIDTKKSSLNVSGYNFSLGAAVKAGACMLDGGNMLETIKVSPQTMDGILKSILKVKKALGMFISDTPGERNPYENILYKICLSGDGWPYIASRTSITGRAWENTVVDLESDEKPQKAGSNNSNKSLQSAGFTAGLTYSQLMTLKDAMLQLDPNAKTWMDIEGRPEDPVEIALYQPSSGCYIHFFREPTDLKQFKQDAKYSHGIDITDLFAAQPGLTSAVIDALPRNMVITCQGSDDIRKLLESQGRKDIKLIDIALNKADSRKYENAVWDQYKDLCHMHTGVVVEKKKRGGKEEITPHCALMDCIMFDAAVSGGLKTLVLRAVLPRDMVFRTSTPRVVL

SEQ ID NO: 190 - protein, 569 aa, Artificial Sequence
  derived and/or modified protein sequence (wt) from Lassa virus__AAT48999__NP
MSVSKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLILAADLEKLKSKVTRTERPLSAGVYMGNLSSQQLDQRRALLNMIGMSGGNQGAQTGRDGVVRIWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESGEKPQKIGSNNSNKCLQSAGFTAGLSYSQLMTLKDAMLQLDPNAKTWMDIEGRPEDPVEIALYQPSSGCYIHFFREPTDLKQFKQDAKYSHGIDVTDLFAAQPGLTSAVIEALPRNMVMTCQGSDDIRKLLESQGRKDIKLIDIALSKTDSRKYENAVWDQYKDLCHMHTGVVVEKKKKGGKEEITPHCALMDCIMFDAAVSGGLNTSVLRAVLPRDMVFRTSTPKVVL

SEQ ID NO: 191 - protein, 569 aa, Artificial Sequence
  derived and/or modified protein sequence (wt) from Lassa virus__AAT49007__NP
MSVSKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLILAADLEKLKSKVTRTERPLSAGIYMGNLSSQQLDQRRALLNMIGMSGGNQGAQTGRDGVVRIWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESGEKPQKIGSNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIEALPRNMVMTCQGSDDIRKLLESQGRKDIKLIDIALSKTDSRKYENAVWDQYKDLCHMHTGVVVEKKKKGGKEEITPHCALMDCIMFDAAASGGLNTLVLRAVLPRDMVFRTSTPKVVL

SEQ ID NO: 192 - protein, 569 aa, Artificial Sequence
  derived and/or modified protein sequence (wt) from Lassa virus__AAT49009__NP
MSASKEVKSFLWTQSLRRELSGYCSNIKLQVVKDAQALLHGLDFSEVSNVQRLMRKQRRDDGDLKRLRDLNQAVNNLVELKSTQQKSVLRVGTLNSDDLLVLAADLEKLKSKVIRTERPLSSGIYMGNLSSQQLDQRRALLNMIGMTGGNRGGGTSSDGIVRVWDVKNAELLNNQFGTMPSLTLACLTKQGQVDLNDAVQALTDLGLIYTAKYPNSSDLDRLAQSHPILNMIDTKKSSLNISGYNFSLGAAVKAGACMLDGGNMLETIKVSPQTIDGILKTILKVKKSLGMFISDVPGERNPYENILYKICLSGDGWPYIASRTSIVGRAWENTVVDLESDNKPQKTGNGGSNKSLQSAGFAAGLTYSQLMTLKDSMLQLDPNSKTWMDIEGRPEDPVEIALYQPNSGCYIHFFREPTDLKQFKQDAKYSHGIDVTDLFAAQPGLTSAVIEALPRNMVITCQGSEDIRKLLESQGRRDIKLIDISLNKADSRKFENAVWDQFKDLCHMHTGVVVEKKKRGGKEEITPHCALMDCIMFDAAVSGGLDAKVLRAVLPRDMVFRTSTPKVVL

SEQ ID NO: 193 - protein, 569 aa, Artificial Sequence
  derived and/or modified protein sequence (wt) from Lassa virus__ADI39452__NP
MSVSKEVKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLILAADLEKLKTKVTRTERPLSAGVYMGNLSSQQLEQRRALLNMIGMNGGNQGVQAGRDGVVRVWDVKNAELLNNQFGTMPSLTLACLTKQGQVDLNDAVQALTDLGLIYTAKYPNTSDLDRLAQSHPILNMIDTKKSSLNISGYNFSLGAAVKAGACMLDGGNMLETIKVSPQTMDGILKSILKVKRTLGMFVSDTPGERNPYENILYKICLSGDGWPYIASRTSITGRAWENTIVDLESDGKPQKVGNNGSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIEALPRNMVITCQGSEDVRKLLESQGRKDIKLIDIALSKADSRKYENAVWDQYKDLCHMHTGVVVEKKKRGGKEEMTPHCALMDCIMFDAAVSGGLSTQVLRAVLPRDMVFRTSTPKVVL

SEQ ID NO: 194 - protein, 569 aa, Artificial Sequence
  derived and/or modified protein sequence (wt) from Lassa virus__ADU56611__NP
MSASKEVKSFLWTQSLRRELSGYCSNIKLQVVKDAQALLHGLDFSEVSNVQRLMRKQKRDDGDLKRLRDLNQAVNNLVELKSTQQKSVLRVGTLTSDDLLTLAADLEKLKSKVIRTERPLSSGVYMGNLSTQQLEQRKALLSMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFSAQPGLTSAVIEALPRNMVLTCQGSDDIKKLLDSQGRRDIKLIDISLNKADSRRFENAVWDQCKDLCHMHTGVVVEKKKRGGKEEITPHCALMDCIMFDAAVSGGLNIPILRAVLPRDMVFRTSSPKVVL

SEQ ID NO: 195 - protein, 569 aa, Artificial Sequence
  derived and/or modified protein sequence (wt) from Lassa virus__ADU56615__NP
MSASKEVKSFLWTQSLRRELSGYCSNIKLQVVKDAQALLHGLDFSEVSNVQRLMRKQKRDDSDLKRLRDLNQAVNNLVELKSTQQKSVLRIGTLSSDDLLILAADLEKLKSKVVRTERPLSSGIYMGNLSSQQLDQRKALLNMIGMTGGNGGRNATSDGIVRVWDVKNAELLNNQFGTMPSLTLACLTKQGQVDLNDAVQALTDLGLIYTAKYPNSSDLDRLAQSHPILNMIDTKKSSLNISGYNFSLGAAVKAGACMLDGGNMLETIKVSPQTMDGILKSILKVKRSLGMFISDTPGERNPYENILYKICLSGDGWPYIASRTSIVGRAWENTVVDLETDNKPQKTGNGGSNKSLQSAGFAAGLTYSQLMTLKDSMLQLDPNAKTWMDIEGRPEDPVEIALYQPVSGCYIHFFREPTDLKQFKQDAKYSHGIDVTDLFAAQPGLTSAVIEALPRNMVITCQGSEDIRKLLESQGRRDIKLIDISLSKVDSRKFENAVWDQFKDLCHMHTGIVVEKKKRGGKEEITPHCALMDCIMFDAAVSGGVDAKVLRAVLPRDMVFRTSTPKVVL

SEQ ID NO: 196 - protein, 569 aa, Artificial Sequence
  derived and/or modified protein sequence (wt) from Lassa virus__ADU56619__NP
MSASKEVKSFLWTQSLRRELSGYCSNIKLQVVKDAQALLHGLDFSEVSNVQRLMRKQKRDDGDLKRLRDLNQAVNNLVELKSTQQKSVLRVGTLSSDDLLVLAADLEKLKSKVVRTERPLSSGIYMGNLSSQQLDQRKALLNMIGMTGGNGGRNTTSDGIVRVWDVKNAELLNNQFGTMPSLTLACLTKQGQVDLNDAVQALTDLGLIYTAKYPNSSDLDRLAQSHPILNMIDTKKSSLNISGYNFSLGAAVKAGACMLDGGNMLETIKVSPQTMDGILKSILKVKRSLGMFISDTPGERNPYENILYKICLSGDGWPYIASRTSIVGRAWENTVVDLESDNKPQKTGNGGSNKSLQSAGFAAGLTYSQLMTLKDSMLQLDPNAKTWMDIEGRPEDPVEIALYQPSSGCYIHFFREPTDLKQFKQDAKYSHGIDVTDLFAAQPGLTSAVIEALPRNMVITCQGSEDIRKLLESQGRRDIKLIDISLSKVDSRKFENAVWDQFKDLCHMHTGIVVEKKKRGGKEEITPHCALMDCIMFDAAVSGGVDAKVLRAVLPRDMVFRTSTPKVVL

SEQ ID NO: 197 - protein, 569 aa, Artificial Sequence
  derived and/or modified protein sequence (wt) from Lassa virus__ADU56623__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNLIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKKSLGMFVSDTPGERNPYENILYKICLSGDGWPYIASRTSIVGRAWENTTVDLESDGKPHKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 198 - protein, 569 aa, Artificial Sequence
  derived and/or modified protein sequence (wt) from Lassa virus__ADU56627__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLNTQQLEQRRALLNMIGMAGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 199 - protein, 569 aa, Artificial Sequence
  derived and/or modified protein sequence (wt) from Lassa virus__ADU56631__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 200 - protein, 569 aa, Artificial Sequence
  derived and/or modified protein sequence (wt) from Lassa virus__AFY05580__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLRSKVIRTERPLSAGVYMGNLSSQQLDQRRALLNMIGMSGGNQGARAGRDGVVRVWDVKNAELLSNQFGTIPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESGGKPQKADSNNSSKSLQSAGFTAGLTYSQLMTLKDAMLQLDPNAKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 201 - protein, 569 aa, Artificial Sequence
  derived and/or modified protein sequence (wt) from Lassa virus__AFY05581__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLNMIGMSGGNQGARAGRDGVVRVWDVKNAELLSNQFGTIPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESGGKPQKADSNNSSKSLQSAGFTAGLTYSQLMTLKDAMLQLDPNAKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLKAVLPRDMVFRTSTPRVVL

SEQ ID NO: 202 - protein, 569 aa, Artificial Sequence
  derived and/or modified protein sequence (wt) from Lassa virus__AFY05587__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLRSKVIRTERPLSAGVYMGNLSSQQLDQRRALLNMIGMSGGNQGARAGRDGVVRVWDVKNAELLSNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNNSSKSLQSAGFTAGLTYSQLMTLKDAMLQLDPNAKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 203 - protein, 569 aa, Artificial Sequence
  derived and/or modified protein sequence (wt) from Lassa virus__AFY05591__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLNMIGMSGGNQGARAGRDGVVRVWDVKNVELLSNQFGTMPSLTLACLTKQGQVDLNDAVQALTDLGLIYTAKYPNTSDLDRLAQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNNSSKSLQSAGFTAGLTYSQLMTLKDAMLQLDPNAKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 204 - protein, 569 aa, Artificial Sequence
  derived and/or modified protein sequence (wt) from Lassa virus__AFY05597__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLNMIGMSGGNQGARAGRDGVVRVWDVKNAELLSNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNNSSKSLQSAGFTAGLTYSQLMTLKDAMLQLDPNAKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 205 - protein, 569 aa, Artificial Sequence
  derived and/or modified protein sequence (wt) from Lassa virus__AFY05610__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLNMIGMSGGNQGARAGRDGVVRVWDVKNAELLSNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNNSSKSLQSAGFTAGLTYSQLMTLKDAMLQLDPNTKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 206 - protein, 569 aa, Artificial Sequence
  derived and/or modified protein sequence (wt) from Lassa virus__AFY05616__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLNMIGMSGGNQGARAGRDGVVRVWDVKNAELLSNQFGTMPSLTLACLTKQGQVDLNDAVQALTDLGLIYTAKYPNTSDLDRLAQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNNSSKSLQSAGFTAGLTYSQLMTLKDAMLQLDPNAKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 207 - protein, 571 aa, Artificial Sequence
  derived and/or modified protein sequence (wt) from Lassa virus__AFY05618__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLRSKVIRTERPLSAGVYMGNLSSQQLDQRRALLNMIGMSGGNQGARAGRDGVVRVWDVKNAELLSNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNNSSKSLQSAGFTAGLTYSQLMTLKDAMLQLDPNAKTWMDIEGRPEDPVEIALYQPSSGCYIHFFREPTDLKQKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 208 - protein, 569 aa, Artificial Sequence
  derived and/or modified protein sequence (wt) from Lassa virus__AHC95552__NP
MSASKEVKSFLWTQSLRRELSGYCSNIKLQVVKDAQALLHGLDFSEVSNVQRLMRKQRRDDGDLKRLRDLNQAVNNLVELKSTQQKNVLRVGTLNSDDLLTLAADLEKLKSKVTRTERPLSSGVYMGNLSSQQLDQRRALLNMIGMTGGNQGTQAGRDGVVRVWDVKNAELLNNQFGTMPSLTLACLTKQGQADLNDVVQALTDLGLIYTAKYPNASDLDRLTQSHPILNMIDTKKSSLNISGYNFSLGAAVKAGACMLDGGNMLETIKVSPQSMDGILKSILKVKRALGMFVSDTPGERNPYENILYKICLSGDGWPYIASRTSIVGRAWENTVVDLEADGNPKKLNSNGSNKSLQSAGFPAGLTYSQLMTLKDAMLQLDPNAKTWMDIEGRPEDPVEVALYQPNSGCYIHFFREPTDLKQFKQDAKYSHGIDVTDLFAAQPGLTSAVIEALPRNMVITCQGSEDIRKLLESQGRKDIKLIDIALSKTDSRKFENAVWDQYKDLCHMHTGVVVEKKKRGGKEEITPHCALMDCIMFDAAVSGGLNTLVLRAVLPRDMVFRTSTPRVVL

SEQ ID NO: 209 - protein, 569 aa, Artificial Sequence
  derived and/or modified protein sequence (wt) from Lassa virus__AHC95554__NP
MSASKEVRSFLWTQSLRRELSGYCSNIKLQVVKDAQALLHGLDFSEVSNVQRLMRKQRRDDGDLKRLRDLNQAVNNLVELKSTQQKSVLRVGTLNSDDLLTLAADLEKLKSKVTRTERPLSSGVYMGNLSSQQLDQRRALLNMIGMTGGNQGAQAGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKISPQSVDGILKSILKVKRSLGMFVSDTPGERNPYENILYKICLSGDGWPYIASRTSIVGRAWENTVVDLEADGKPQKPNSGSSNKSLQSAGFPAGLTYSQLMTLKDAMLQLDPNAKTWMDIEGRPEDPVEVALYQPSSGCYIHFFREPTDLKQFKQDAKYSHGIDVTDLFAAQPGLTSAVIEALPRNMVITCQGSEDIKKLLESQGRKDIKLIDIALSKIDSRKFENAVWDQYKDLCHMHTGVVVEKKKRGGKEEITPHCALMDCIMFDAAVSGGLNASVLRAVLPRDMVFRTSTPKVVL

SEQ ID NO: 210 - protein, 569 aa, Artificial Sequence
  derived and/or modified protein sequence (wt) from Lassa virus__AHC95556__NP
MSASKEVKSFLWTQSLRRELSGYCSNIKLQVVKDAQALLHGLDFSEVSNVQRLMRKQRRDDGDLKRLRDLNQAVNNLVELKSTQQKNVLRVGTLNSDDLLTLAADLEKLKSKVTRTERPLSSGVYMGNLSSQQLDQRRALLNMIGMTGGNQGTQTGRDGVVRVWDVKNAELLNNQFGTMPSLTLACLTKQGQADLNDVVQALTDLGLIYTAKYPNASDLDRLTQSHPILNMIDTKKSSLNISGYNFSLGAAVKAGACMLDGGNMLETIKVSPQSMDGILKSILKVKRALGMFVSDTPGERNPYENILYKICLSGDGWPYIASRTSIVGRAWENTVVDLEADGNPKKLNSNGSNKSLQSAGFPAGLTYSQLMTLKDAMLQLDPNAKTWMDIEGRPEDPVEVALYQPNSGCYIHFFREPTDLKQFKQDAKYSHGIDVTDLFAAQPGLTSAVIEALPRNMVITCQGSEDIRKLLESQGRKDIKLIDIALSKTDSRKFENAVWDQHKDLCHMHTGVVVEKKKRGGKEEITPHCALMDCIMFDAAVSGGLNTLVLRAVLPRDMVFRTSTPKVVL

SEQ ID NO: 211 - protein, 569 aa, Artificial Sequence
  derived and/or modified protein sequence (wt) from Lassa virus__AHC95558__NP
MSASKEVRSFLWTQSLRRELSGYCSNIKLQVVKDAQALLHGLDFSEVSNVQRLMRKQRRDDSDLKRLRDLNQAVNNLVELKSTQQKSVLRVGTLSSDDLLTLAADLEKLKSKVIRTERPLSSGVYMGNLSSQQLDQRRALLNMIGMTGGNQGAQAGRDGVVRVWDVRNAELLNNQFGTMPSLTLACLTKQGQVDLNDVVQALTDLGLIYTAKYPNTSDLDRLTQNHPILNMIDTKKSSLNISGYNFSLGAAVKAGACMLDGGNMLETIKVSPQSIDGILKSILKVKRTLGMFVSDTPGERNPYENILYKICLSGDGWPYIASRTSIVGRAWENTVVDLETDRKSQGPNSGNSNKSLQSAGFSAGLTYSQLMTLKDAMLQLDPNAKTWMDIEGRPEDPVEVALYQPISGCYIHFFREPTDLKQFKQDAKYSHGIDITDLFAAQPGLTSAVIEALPRNMVITCQGSEDIKKLLESQGRKDIKLIDIALSKIDSRKFENAVWDQYKDLCHMHTGVVVEKKKRGGKEEITPHCALMDCIMFDAAVSGGLNASVLRAVLPRDMVFRTSTPKVVL

SEQ ID NO: 212 - protein, 569 aa, Artificial Sequence
  derived and/or modified protein sequence (wt) from Lassa virus__AHC95560__NP
MSASKEVKSFLWTQSLRRELSGYCSNIKLQVVKDAQALLHGLDFSEVSNVQRLMRKQRRDDGDLKRLRDLNQAVNNLVELKSTQQKNVLRVGTLNSDDLLTLAADLEKLKSKVTRTERPLSSGVYMGNLSSQQLDQRRALLNMIGMSGGNQGTQVGRDGVVRVWDVKNAELLNNQFGTMPSLTLACLTKQGQADLNDVVQALTDLGLIYTAKYPNASDLDRLTQSHPILNMIDTKKSSLNISGYNFSLGAAVKAGACMLDGGNMLETIKVSPQSMDGILKSILKVKRALGMFVSDTPGERNPYENILYKICLSGDGWPYIASRTSIVGRAWENTVVDLEADGNPKKLNSNGSNKSLQSAGFPAGLTYSQLMTLKDAMLQLDPNAKTWMDIEGRPEDPVEVALYQPNSGCYIHFFREPTDLKQFKQDAKYSHGIDVTDLFAAQPGLTSAVIEALPRNMVITCQGSEDIRKLLESQGRKDIKLIDIALSKTDSRKFENAVWDQHKDLCHMHTGVVVEKKKRGGKEEITPHCALMDCIMFDAAVSGGLNTLVLRAVLPRDMVFRTSTPKVVL

SEQ ID NO: 213 - protein, 569 aa, Artificial Sequence
  derived and/or modified protein sequence (wt) from Lassa virus__AIT17127__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLSMIGMSGGNQGVRAGKDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNTKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALNKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 214 - protein, 569 aa, Artificial Sequence
  derived and/or modified protein sequence (wt) from Lassa virus__AIT17131__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLSSDDLLVLAADLEKLKSKVTRTERPLSAGVYMGNLSSQQLDQRRALLNMIGMSGGNQGARAGRDGVVRVWDVKNAELLNNQFGTMPSLTLACLTKQGQVDLNDVVQALTDLGLIYTAKYPNTSDLDRLTQSHPILNMVDTKKSSLNISGYNFSLGAAVKAGACMLDGGNMLETIKVSPQTIDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKIWMDIEGRPEDPVEIALYQPSSGCYIHFFREPTDLKQFKQDAKYSHGIDVTDLFAAQPGLTSAVIDALPRNMVITCQGADDIRKLLESQGRKDIKLIDIALNKADSRKYENAVWDQYKDLCHMHTGVVVEKKKRGGKEEITPHCALMDCIMFDAAVSGGLNTSVLRAVLPRDMVFRTSTPRVVL

SEQ ID NO: 215 - protein, 569 aa, Artificial Sequence
  derived and/or modified protein sequence (wt) from Lassa virus__AIT17139__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVTRTERPLSAGVYMGNLSSQQLDQRRALLNMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDSILKSILKVKKALGMFISDTPGERNPYENILYKICLSGDGWPYIASRTSITGRAWENTVVDLESDGKPQKAGSNNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTTTPRVVL

SEQ ID NO: 216 - protein, 569 aa, Artificial Sequence
  derived and/or modified protein sequence (wt) from Lassa virus__AIT17143__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGNNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNLVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 217 - protein, 569 aa, Artificial Sequence
  derived and/or modified protein sequence (wt) from Lassa virus__AIT17147__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVTRTERPLSAGVYMGNLSSQQLEQRRALLNMIGMSGSNQGAQAGRDGVVRVWDVKNAELLNNQFGTMPSLTLACLTKQGQVDLNDAVQALTDLGLIYTVKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNSSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 218 - protein, 569 aa, Artificial Sequence
  derived and/or modified protein sequence (wt) from Lassa virus__AIT17151__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLSMIGMSGGNQGARAGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKLQKAGSNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALNKTDSRKYENAVWDQYKDLCHMHTGVVVEKKKKGGKEEITPHCALMDCIMFDAAVSGGLNTSVLRAVLPRDMVFRTSTPRVVL

SEQ ID NO: 219 - protein, 569 aa, Artificial Sequence
  derived and/or modified protein sequence (wt) from Lassa virus__AIT17155__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDELLVLAADLEKLKSKVIRTERPLSAGVYMGNLSSQQLDQRRALLSMIGMSGGNQGARTGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKIDSRKYENAVWDQYKDLCHMHTGVVVEKKKRGGKEEITPHCALMDCIMFDAAVSGGLNSLVLRAVLPRDMVFRTSTPRVVL

SEQ ID NO: 220 - protein, 569 aa, Artificial Sequence
  derived and/or modified protein sequence (wt) from Lassa virus__AIT17161__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGARTGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNSSNKSLQSAGLTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNLVITCQGSDDIRKLLESQGRKDIKLIDIALSKTDSRKYENAVWDQYKDLCHMHTGIVVEKKKRGGKEEITPHCALMDCIMFDAAVSGGLNASVLRAVLPRDMVFRTSTPRVVL

SEQ ID NO: 221 - protein, 569 aa, Artificial Sequence
  derived and/or modified protein sequence (wt) from Lassa virus__AIT17165__NP
MSASKEIKSFLWTQSLRRELSGYCSNIKLQVVKDAQALLHGLDFSEVNNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSNGNQGTRAGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSSNSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIRKLLESQGRKDIKLIDIALSKADSRKYENAVWDQHKDLCHMHTGVVVEKKKRGGKEEITPHCALMDCIMYDAAVSGGLNTSVLRAVLPRDMVFRTSTPRVVL

SEQ ID NO: 222 - protein, 569 aa, Artificial Sequence
  derived and/or modified protein sequence (wt) from Lassa virus__AIT17169__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLSMIGMSSGNQRAQAGRDGVVRVWDVKNVELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSVGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 223 - protein, 569 aa, Artificial Sequence
  derived and/or modified protein sequence (wt) from Lassa virus__AIT17173__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDAPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLFESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 224 - protein, 569 aa, Artificial Sequence
  derived and/or modified protein sequence (wt) from Lassa virus__AIT17177__NP
MSASKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLVLAADLEKLKSKVIRTERPLSAGIYMGNLSSQQLDQRRALLNMIGMSGGNQGARAGRDGVVRVWDVKNADLLNNQFGTMPSLTLACLTKQGQVDLNDVVQALTDLGLIYTAKYPNTSDLDRLTQSHPILKMIDANKSSLNISGYNFSLGAAVKAGACMLDGGNMLETIKVSPQTMDGILKSILKVKKSLGMFISDTPGERNPYENILYKICLSGDGWPYIASRTSIIGRAWENTVVDLESDGKPQKTGSNNSSKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIEALPRNMVITCQGSDDIRKLLESQGRKDIKLIDIALSKTDSRKYENAVWDQYKDLCHMHTGIVVEKKKRGGKEEITPHCALMDCIMFDAAVSGGLNTLVLRAVLPRDMVFRTSTPKVVL

SEQ ID NO: 225 - protein, 569 aa, Artificial Sequence
  derived and/or modified protein sequence (wt) from Lassa virus__AIT17181__NP
MSASKEVKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLVLAADLEKLKSKVIRTERPLSAGVYMGNLSSQQLDQRRALLNMIGMSGGIQGTRTGRDGVVRVWDVKNADLLNNQFGTMPSLTLACLTKQGQVDLNDVVQALTDLGLIYTAKYPNASDLDRLTQSHPILNMIDTKKSSLNISGYNFSLGAAVKAGACMLDGGNMLETIKVSPQTMDGILKSILKVKKTLGMFISDTPGERNPYENILYKICLSGDGWPYIASRTSITGRAWENTVVDLESDGKPQKAGSNNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIEALPRNMVITCQGSDDIKKLLESQGRKDIKLIDIALSKTDSRKYENAVWDQYKDLCHMHTGVVVEKKKRGGKEEITPHCALMDCIMFDAAVSGGLNTLVLRAVLPRDMVFRTSTPRVVL

SEQ ID NO: 226 - protein, 569 aa, Artificial Sequence
  derived and/or modified protein sequence (wt) from Lassa virus__AIT17185__NP
MSASKEIKSFLWTQSLRRELSGYCSNIKLQVVKDAQALLHGLDFSEVSNVQRLMRKQRRDDGDLKRLRDLNQAVNNLVELKSTQQKSVLRVGTLTSDDLLILAADLEKLKSKVTRTERPLSAGVYMGNLSSQQLDQRRALLNMIGMSGGNRGARTGKDGVVRIWDVKNADLLNNQFGTMPSLTLACLTKQGQVDLNDVVQALTDLGLIYTAKYPNTSDLDRLTQSHPILNMIDTNKSSLNISGYNFSLGAAVKAGACMLDGGNMLETIKVSPQTMDGILKSILKVKKSLGMFISDTPGERNPYENILYKICLSGDGWPYIASRTSITGRAWENTVVDLESDEKPQKAGSNNSNKSLQSTGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDTLPRNMVITCQGSDDIRKLLESQGRKDIKLIDIALSKTDSRKYENAVWDQYKDLCHMHTGVVVEKKKRGGKEEITPHCALMDCIMFDAAVSGGLNASVLRAVLPRDMVFRTSTPRVVL

SEQ ID NO: 227 - protein, 569 aa, Artificial Sequence
  derived and/or modified protein sequence (wt) from Lassa virus__AIT17189__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVTRTERPLSAGVYMGNLSSQQLDQRRALLSMIGMSGGNQGARTGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTIDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNSLVLRAVLPRDMVFRTSTPRVVL

SEQ ID NO: 228 - protein, 569 aa, Artificial Sequence
  derived and/or modified protein sequence (wt) from Lassa virus__AIT17193__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVTRTERPLSAGVYMGNLSSQQLDQRRALLSMIGMSGGNQGARTGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGNNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNSLVLRAVLPRDMVFRTSTPRVVL

SEQ ID NO: 229 - protein, 569 aa, Artificial Sequence
  derived and/or modified protein sequence (wt) from Lassa virus__AIT17197__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSLQQLDQRRALLNMIGMSGSNQGVRAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 230 - protein, 569 aa, Artificial Sequence
  derived and/or modified protein sequence (wt) from Lassa virus__AIT17201__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDAPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIKKLFESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 231 - protein, 569 aa, Artificial Sequence
  derived and/or modified protein sequence (wt) from Lassa virus__AIT17205__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRKALLNMIGMSGSNQGARIGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNSSNKSLQSAGLTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNLVITCQGSDDIRKLLESQGRKDIKLIDIALSKTDSRKYENAVWDQYKDLCHMHTGIVVEKKKRGGKEEITPHCALMDCIMFDAAVSGGLNASVLRAVLPRDMVFRTSTPRVVL

SEQ ID NO: 232 - protein, 569 aa, Artificial Sequence
  derived and/or modified protein sequence (wt) from Lassa virus__AIT17209__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLSMIGMSGGNQGARAGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKLQKTGSNNSNKSLQSAGFTAGLTYSQLMTLKDAMLQLDPNAKIWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALNKTDSRKYENAVWDQYKDLCHMHTGVVVEKKKKGGKEEITPHCALMDCIMFDAAVSGGLNTSVLRAVLPRDMVFRTSTPRVVL

SEQ ID NO: 233 - protein, 569 aa, Artificial Sequence
  derived and/or modified protein sequence (wt) from Lassa virus__AIT17211__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGGNQGAQAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKANSNSSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 234 - protein, 569 aa, Artificial Sequence
  derived and/or modified protein sequence (wt) from Lassa virus__AIT17213__NP
MSASKEIKSFLWTQSLRRELAGYCSNIKLQVVKDAQALLHGLDFSEVSNVQRLMRKERRDDNDLKRLRDLNQAVNNLVELKSTQQKSVLRVGTLTSDDLLILAADLEKLKSKVIRTERPLSAGVYMGNLSSQQLDQRRALLNMIGMSGSNQGVRAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 235 - protein, 569 aa, Artificial Sequence
  derived and/or modified protein sequence (wt) from Lassa virus__AIT17217__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLSMIGMSSGVQGARAGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISETPGERNPYENILYKICLSGDGWPYIASRTSITGRAWENTVVDLESDGKPQKAGSNNSNKSLQSTGFAAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIKKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 236 - protein, 569 aa, Artificial Sequence
  derived and/or modified protein sequence (wt) from Lassa virus__AIT17225__NP
MSASKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLVLAADLEKLKSKVTRTERPLSAGVYMGNLSSQQLDQRRALLNMIGMSGGNQGARAGNDGVVRVWDVKNADLLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKTGNNSSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIEALPRNMVITCQGSDDIRKLLESQGRKDIKLIDIALSKIDSRKYENAVWDQYKDLCHMHTGVVVEKKKRGGKEEITPHCALMDCIMFDAAVSGGLNTLVLRAVLPRDMVFRTSTPKVVL

SEQ ID NO: 237 - protein, 569 aa, Artificial Sequence
  derived and/or modified protein sequence (wt) from Lassa virus__AIT17229__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVIRTERPLSAGVYMGNLSSQQLDQRRALLSMIGMSGGNQGTRAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKADSRKYENAVWDQYKDLCHMHTGVVVEKKKRGGKEEITPHCALMDCIMFDAAVSGGLNTSVLRAVLPRDMVFRTSTPRVVL

SEQ ID NO: 238 - protein, 569 aa, Artificial Sequence
  derived and/or modified protein sequence (wt) from Lassa virus__AIT17233__NP
MSASKEVKSFLWTQSLRRELSGYCSNIKLQVVKDAQALLHGLDFSEVSNVQRLMRKERRDDNDLKRLRDLNQAVNNLVELKSTQQKSILRVGTLTSDDLLVLAADLEKLKSKVTRTERPLSAGVYMGNLSSQQLDQRRALLSMIGMSGGNQGAQAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 239 - protein, 569 aa, Artificial Sequence
  derived and/or modified protein sequence (wt) from Lassa virus__AIT17237__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLSMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 240 - protein, 569 aa, Artificial Sequence
  derived and/or modified protein sequence (wt) from Lassa virus__AIT17241__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLSMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLFESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 241 - protein, 569 aa, Artificial Sequence
  derived and/or modified protein sequence (wt) from Lassa virus__AIT17245__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGARTGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGLTAGLTYSQLMTLKDAMLQLDPNAKTWMDIEGRPEDPVEIALYQPSSGCYIHFFREPTDLKQFKQDAKYSHGIDVADLFAAQPGLTSAVIDALPRNLVITCQGSDDIRKLLESQGRKDIKLIDIALSKTDSRKYENAVWDQYKDLCHMHTGIVVEKKKRGGKEEITPHCALMDCIMFDAAVSGGLNASVLRAVLPRDMVFRTSTPRVVL

SEQ ID NO: 242 - protein, 569 aa, Artificial Sequence
  derived and/or modified protein sequence (wt) from Lassa virus__AIT17247__NP
MSASKEIKSFLWTQSLRRELSGYCSNIKLQVVKDAQALLHGLDFSEVSNVQRLMRKQRRDDSDLKRLRDLNQAVNNLVELKSTQQKSVLRVGTLTSDDLLILAADLEKLKSKVIRTERPLSSGVYMGNLSSQQLDQRRALLNMIGMSGGNQGAQVGRDGVVRVWDVKNADLLNNQFGTMPSLTLACLTKQGQVDLNDVVQALTDLGLIYTAKYPNTSDLDRLAQSHPILNMIDTKKSSLNISGYNFSLGAAVKAGACMLDGGNMLETIKVSPQTMDGILKSILKVKKALGMFISETPGERNPYENILYKICLSGDGWPYIASRTSITGRAWENTIVDLESDGKPQKAGSNNSNKSLQSAGFTAGLTYSQLMTLKDSMLQLDPNAKTWMDIEGRPEDPVEVALYQPSSGCYIHFFREPTDLKQFKQDAKYSHGIDVTDLFAAQPGLTSAVIEALPRNMVITCQGSDDIRKLLESQGRKDIKLIDIALNKTDSRKYENAVWDQYKDLCHMHTGVVVEKKKRGGKEEITPHCALMDCIMFDAAVSGGLKTLVLRAVLPRDMVFRTSTPKVVL

SEQ ID NO: 243 - protein, 569 aa, Artificial Sequence
  derived and/or modified protein sequence (wt) from Lassa virus__AIT17251__NP
MSASKEIKSFLWTQSLRRELSGYCSNIKLQVVKDAQALLHGLDFSEVSNVQRLMRKQRRDDSDLKRLRDLNQAVNNLVELKSTQQKSVLRVGTLTSDDLLILAADLEKLKSKVIRTERPLSSGVYMGNLSSQQLDQRRALLNMIGMSGGNQGAQVGRDGVVRVWDVKNADLLNNQFGTMPSLTLACLTKQGQVDLNDVVQALTDLGLIYTAKYPNTSDLDRLAQSHPILNMIDTKKSSLNISGYNFSLGAAVKAGACMLDGGNMLETIKVSPQTMDGILKSILKVKKALGMFISETPGERNPYENILYKICLSGDGWPYIASRTSITGRAWENTIVDLESDGKPQKTGSNNSNKSLQSAGFTAGLTYSQLMTLKDSMLQLDPNAKTWMDIEGRPEDPVEVALYQPSSGCYIHFFREPTDLKQFKQDAKYSHGIDVTDLFAAQPGLTSAVIEALPRNMVITCQGSDDIRKLLESQGRKDIKLIDIALNKTDSRKYENAVWDQYKDLCHMHTGVVVEKKKRGGKEEITPHCALMDCIMFDAAVSGGLKTLVLRAVLPRDMVFRTSTPKVVL

SEQ ID NO: 244 - protein, 569 aa, Artificial Sequence
  derived and/or modified protein sequence (wt) from Lassa virus__AIT17255__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLVLAADLEKLKSKVTRTERPLSAGVYMGNLSSQQLDQRRALLSMIGMSGGNQRAQAGRDGVVRVWDVKNAELLNNQFGTMPSLTLACLTKQGQVDLNDAVQALTDLGLIYTVKYPNASDLDRLTQSHPILNMIDTKKSSLNISGYNFSLGAAVKAGACMLDGGNMLETIKVSPQTMDGILKSILKVKKTLGMFISDTPGERNPYENILYKICLSGDGWPYIASRTSITGRAWENTVVDLESNGKPQKADSNSSNKSLQSAGFTAGLTYSQLMTLKDAMLQLDPNAKTWMDIEGRPEDPVEIAFYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTLVLRAVLPRDMVFRTSTPRVVL

SEQ ID NO: 245 - protein, 569 aa, Artificial Sequence
  derived and/or modified protein sequence (wt) from Lassa virus__AIT17259__NP
MSASKEIKSFLWTQSLRRELSSYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMLGMSGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNSSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNASVLRAVLPRDMVFRTSTPRVVL

SEQ ID NO: 246 - protein, 569 aa, Artificial Sequence
  derived and/or modified protein sequence (wt) from Lassa virus__AIT17263__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVIRTERPLSAGVYMGNLSSQQLDQRRALLNMIGMGGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNGSNKSLQSAGFTAGLTYSQLMTLKDAMLQLDPNTKTWMDIEGRPEDPVEVALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 247 - protein, 569 aa, Artificial Sequence
  derived and/or modified protein sequence (wt) from Lassa virus__AIT17267__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVTRTERPLSAGVYMGNLSSQQLDQRRALLNMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDSILKSILKVKKALGMFISDTPGERNPYENILYKICLSGDGWPYIASRTSITGRAWENTVVDLESDGKPQKAGSNNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTSVLRAVLPRDMVFRTTTPRVVL

SEQ ID NO: 248 - protein, 569 aa, Artificial Sequence
  derived and/or modified protein sequence (wt) from Lassa virus__AIT17271__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKTILKVKKALGMFISDTPGERNPYENILYKICLSGDGWPYIASRTSITGRAWENTVVDLESDGKPQKTGSNNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKADSRKYENAVWDQYKDLCHMHTGVVVEKKKRGGKEEITPHCALMDCIMYDAAVSGGLSTSVLRAVLPRDMVFRTSTPRVVL

SEQ ID NO: 249 - protein, 569 aa, Artificial Sequence
  derived and/or modified protein sequence (wt) from Lassa virus__AIT17275__NP
MSASKEIKSFLWTQSLRRELSGYCSNIKLQVVKDAQALLHGLDFSEVSNVQRLMRKQRRDDGDLKRLRDLNQAVNNLVELKSTQQKSVLRVGTLTSDDLLTLAADLEKLKSKVTRTERPLSAGVYMGNLSSQQLDQRRALLNMIGMSGGNQGARTGKDGVVRIWDVKNADLLNNQFGTMPSLTLACLTKQGQVDLNDVVQALTDLGLIYTAKYPNISDLDRLAQSHPILKMIDTSKSSLNISGYNFSLGAAVKAGACMLDGGNMLETVKVSPQTMDGILKSILKVKKSLGMFISDTPGERNPYENILYKICLSGDGWPYIASRTSITGRAWENTVVDLESDGKPQKVGSNNSNKSLQSTGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDTLPRNMVITCQGSDDIGKLLESQGRKDIKLIDIALSKTDSRKYENAVWDQYKDLCHMHTGVVVEKKKRGGKEEITPHCALMDCIMFDAAVSGGLNASVLRAVLPRDMVFRTSTPRVVL

SEQ ID NO: 250 - protein, 569 aa, Artificial Sequence
  derived and/or modified protein sequence (wt) from Lassa virus__AIT17277__NP
MSASKEIKSFLWTQSLRRELSSYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLSMIGMSGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 251 - protein, 569 aa, Artificial Sequence
  derived and/or modified protein sequence (wt) from Lassa virus__AIT17281__NP
MSASKEIKSFLWTQSLRRELSGYCSNIKLQVVKDAQALLHGLDFSEVSNVQRLMRKERRDDSDLKRLRDLNQAVNNLVELKSTQQKSVLRVGTLTSDDLLVLAADLEKLKSKVTRTERPLSAGVYMGNLSSQQLDQRRALLSMIGMSGGNQGARAGRDGVVRIWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTIVDLESDGKPQKTSTTNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDTLPRNMVITCQGSEDIRRLLESQGRKDIKLIDIALSKTDSRKYENAVWDQYKDLCHMHTGVVVEKKKKGGKEEITPHCALMDCIMFDAAVSGGLNTSVLRAVLPRDMVFRTSTPRVVL

SEQ ID NO: 252 - protein, 569 aa, Artificial Sequence
  derived and/or modified protein sequence (wt) from Lassa virus__AIT17285__NP
MSASKEIKSFLWTQSLRRELSGYCSNIKLQVVKDAQALLHGLDFSEVSNVQRSMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGARAGRDGVVRVWDVKNAELLNNQFGTMPSLTLACLTKQGQVDLNDVVQALTDLGLIYTAKYPNASDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTIVDLESDGKPQKAGNNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNLVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 253 - protein, 569 aa, Artificial Sequence
  derived and/or modified protein sequence (wt) from Lassa virus__AIT17289__NP
MSASKEIKSFLWTQSLRRELSGYCSNIKLQVVKDAQALLHGLDFSEVSNVQRLMRKERRDDSDLKRLRDLNQAVNNLVELKSTQQKSVLRVGTLTSDDLLVLAADLEKLKSKVTRTERPLSAGVYMGNLSSQQLDQRRALLSMIGMSGGNQGVRAGRDGVVRIWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTIVDLESDGKPQKTGSINSNKSLQSTGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 254 - protein, 569 aa, Artificial Sequence
  derived and/or modified protein sequence (wt) from Lassa virus__AIT17293__NP
MSASKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLVLAADLEKLKSKVTRTERPLSAGVYMGNLSTQQLDQRRALLNMIGMSGGNQGARAGRDGVVRVWDVKNADLLNNQFGTMPSLTLACLTKQGQVDLNDVVQALTDLGLIYTAKYPNTSDLDRLTQSHPILNMIDTNKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGGNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCNMHTGIVVEKKKRGGKEEITPHCALMDCIMFDAAVSGGMNTSVLRAVLPRDMVFRTSTPRVVL

SEQ ID NO: 255 - protein, 569 aa, Artificial Sequence
  derived and/or modified protein sequence (wt) from Lassa virus__AIT17295__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVIRTERPLSAGVYMGNLSSQQLDQRRALLNMIGMGGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTIVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAIIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 256 - protein, 569 aa, Artificial Sequence
  derived and/or modified protein sequence (wt) from Lassa virus__AIT17299__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLVLAADLEKLKSKVTRTERPLSAGVYMGNLSSQQLDQRRALLSMIGMSGGNQGARTGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEIALYQPSSGCYIHFFREPSDLKQFKQDAKYSHGIDVTDLFAAQPGLTSAVIDALPRNMVITCQGSDDIRKLFESQGRKDIKLIDIALSKTDSRKYENAVWDQYKDLCHMHTGVVVEKKKRGGKEEITPHCALMDCIMFDAAVSGGLNSLVLRAVLPRDMVFRTSTPRVVL

SEQ ID NO: 257 - protein, 569 aa, Artificial Sequence
  derived and/or modified protein sequence (wt) from Lassa virus__AIT17303__NP
MSASKEIKSFLWTQSLRRELSGYCSNIKLQVVKDAQALLHGLDFSEVSNVQRLMRKQRRDDSDLKRLRDLNQAVNNLVELKSTQQKSVLRVGTLTSDDLLVLAADLEKLKSKVIRTERPLSSGVYMGNLSSQQLDQRRALLNMIGMSGGNQGAQVGRDGVVRVWDVKNADLLNNQFGTMPSLTLACLTKQGQVDLNDVVQALTDLGLIYTAKYPNTSDLDRLVQSHPILNMIDTKKSSLNISGYNFSLGAAVKAGACMLDGGNMLETIKVSPQTMDGILKSILKVKKALGMFISETPGERNPYENILYKICLSGDGWPYIASRTSITGRAWENTIVDLESDGKPQKAGSNNSNKSLQSAGFTAGLTYSQLMTLKDSMLQLDPNAKTWMDIEGRPEDPVEVALYQPSSGCYIHFFREPTDLKQFKQDAKYSHGIDVTDLFAAQPGLTSAVIEALPRNMVITCQGSDDIRKLLESQGRKDIKLIDIALNKTDSRKYENAVWDQYKDLCHMHTGVVVEKKKRGGKEEITPHCALMDCIMFDAAVSGGLKTLVLRAVLPRDMVFRTSTPKVVL

SEQ ID NO: 258 - protein, 569 aa, Artificial Sequence
  derived and/or modified protein sequence (wt) from Lassa virus__AIT17307__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVTRTERPLSAGVYMGNLSSQQLDQRRALLSMIGMSGGNQGARTGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKLQKTGSNNSNKSLQSAGFTAGLTYSQLMTLKDAMLQLDPNAKIWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALNKTDSRKYENAVWDQYKDLCHMHTGVVVEKKKKGGKEEITPHCALMDCIMFDAAVSGGLNTSVLRAVLPRDMVFRTSTPRVVL

SEQ ID NO: 259 - protein, 569 aa, Artificial Sequence
  derived and/or modified protein sequence (wt) from Lassa virus__AIT17311__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVIRTERPLSAGVYMGNLSSQQLDQRRALLNMIGMGGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 260 - protein, 569 aa, Artificial Sequence
  derived and/or modified protein sequence (wt) from Lassa virus__AIT17315__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVTRTERPLSAGVYMGNLSSQQLDQRRALLNMIGMSGSNQGARAGRDGVVRVWDVKNVELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNSSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKKGSKEEITPHCALMDCIMFDAAVSGGLNASVLRAVLPRDMVFRTSTPRVVL

SEQ ID NO: 261 - protein, 569 aa, Artificial Sequence
  derived and/or modified protein sequence (wt) from Lassa virus__AIT17319__NP
MSASKEIKSFLWTQSLRRELSGYCSNIKLQVVKDAQALLHGLDFSEVSNVQRLMRKQRRDDSDLKRLRDLNQAVNNLVELKSTQQKSVLRVGTLTSDDLLVLAADLEKLKSKVIRTERPLSSGVYMGNLSSQQLDQRRALLNMIGMSGGNQGAQVGRDGVVRVWDVKNADMLNNQFGTMPSLTLACLTKQGQVDLNDVVQALTDLGLIYTAKYPNTSDLDRLAQSHPILNMIDTKKSSLNISGYNFSLGAAVKAGACMLDGGNMLETIKVSPQTMDGILKSILKVKKALGMFISETPGERNPYENILYKICLSGDGWPYIASRTSITGRAWENTIVDLESDGKPQKAGSNNSNKSLQSAGFTAGLTYSQLMTLKDSMLQLDPNAKTWMDIEGRPEDPVEVALYQPSSGCYIHFFREPTDLKQFKQDAKYSHGIDVTDLFAAQPGLTSAVIEALPRNMVITCQGSDDIRKLLESQGRKDIKLIDIVLNKTDSRKYENAVWDQYKDLCHMHTGVVVEKKKRGGKEEITPHCALMDCIMFDAAVSGGLKTMVLRAVLPRDMVFRTSTPKVVL

SEQ ID NO: 262 - protein, 569 aa, Artificial Sequence
  derived and/or modified protein sequence (wt) from Lassa virus__AIT17323__NP
MSASKEIKSFLWTQSLRRELSGYCSNIKLQVVKDAQALLHGLDFSEVSNVQRLMRKQRRDDSDLKRLRDLNQAVNNLVELKSTQQKSVLRVGTLTSDDLLVLAADLEKLKSKVIRTERPLSSGVYMGNLSSQQLDQRRALLNMIGMSGGNQGAQVGRDGVVRVWDVKNADLLNNQFGTMPSLTLACLTKQGQVDLNDVVQALTDLGLIYTAKYPNTSDLDRLAQSHPILNMIDTKKSSLNISGYNFSLGAAVKAGACMLDGGNMLETIKVSPQTMDGILKSILKVKKALGMFISETPGERNPYENILYKICLSGDGWPYIASRTSITGRAWENTIVDLESDGKPQKAGSNNSNKSLQSAGFTAGLTYSQLMTLKDSMLQLDPNAKTWMDIEGRPEDPVEVALYQPSSGCYIHFFREPTDLKQFKQDAKYSHGIDVTDLFAAQPGLTSAVIEALPRNMVITCQGSDDIRKLLESQGRKDIKLIDIALNKTDSRKYENAVWDQYKDLCHMHTGVVVEKKKRGGKEEITPHCALMDCIMFDAAVSGGLKTLVLRAVLPRDMVFRTSTPKVVL

SEQ ID NO: 263 - protein, 569 aa, Artificial Sequence
  derived and/or modified protein sequence (wt) from Lassa virus__AIT17325__NP
MSASKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLVLAADLEKLKSKVTRTERPLSAGVYMGNLSSQQLDQRRALLNMIGMTGGSRGAQAGGDGVVRVWDVKNADLLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKSLGMFISDTPGERNPYENILYKICLSGDGWPYIASRTSITGRAWENTVVDLESDGKPQKAGGNNSNKSLQSAGFTAGLTYSQLMTLKDTMLQLDPNAKTWMDIEGRPEDPVEVALYQPSSGCYIHFFREPTDLKQFKQDAKYSHGIDVTDLFAAQPGLTSAVIEALPRNMVITCQGSDDIRKLLESQGRKDIKLIDIALSKVDSRKYENAVWDQYKDLCHMHTGVVVEKKKRGGKEEITPHCALMDCIMFDAAVSGGLNTLVLRAVLPRDMVFRTSTPKVVL

SEQ ID NO: 264 - protein, 569 aa, Artificial Sequence
  derived and/or modified protein sequence (wt) from Lassa virus__AIT17329__NP
MSASKEIKSFLWTQSLRRELSGYCSNIKLQVVKDAQALLHGLDFSEVSNVQRLMRKERRDDSDLKRLRDLNQTVNNLVELKSTQQKSILRVGTLTSDDLLILAADLEKLKSKVIRTERPLSAGVYMGNLSSQQLDQRRALLNMIGMSSGNQGAQAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGMPQKAGSSSSNKSLQSAGFVAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKADSRKYENAVWDQYKDLCHMHTGVVVEKKKRGGKEEITPHCALMDCIMYDAAVSGGLNTSVLRAVLPRDMVFRTSTPRVVL

SEQ ID NO: 265 - protein, 569 aa, Artificial Sequence
  derived and/or modified protein sequence (wt) from Lassa virus__AIT17333__NP
MSASKEIKSFLWTQSLRRELSGYCSNIKLQVVKDAQALLHGLDFSEVSNVQRLMRKERRDDNDLKRLRDLNQAVNNLVELKSTQQKSVLRVGTLTSDDLLILAADLEKLKSKVTRTERPLSAGVYMGNLSSQQLDQRRALLNMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDSILKSILKVKKALGMFISDTPGERNPYENILYKICLSGDGWPYIASRTSITGRAWENTVVDLESDGKPQKAGSNNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 266 - protein, 569 aa, Artificial Sequence
  derived and/or modified protein sequence (wt) from Lassa virus__AIT17335__NP
MSASKEIKSFLWTQSLRRELSGYCSNIKLQVVKDAQALLHGLDFSEVSNVQRLMRKERRDDSDLKRLRDLNQAVNNLVELKSTQQKSILRVGTLTSDDLLILAADLEKLKSKVTRTERPLSAGVYMGNLSSQQLDQRRALLSMIGMSSGVQGARAGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISETPGERNPYENILYKICLSGDGWPYIASRTSITGRAWENTVVDLESDGKPQKAGSNNSNKSLQSTGFAAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIKKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 267 - protein, 569 aa, Artificial Sequence
  derived and/or modified protein sequence (wt) from Lassa virus__AIT17341__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDAPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLFESQGRKDIKLIDIALSKADSRKYENAVWDQYKDLCHMHTGVVVEKKKRGGKEEITPHCALMDCIMFDAAVSGGLNTSVLRAVLPRDMVFRTSTPRVVL

SEQ ID NO: 268 - protein, 569 aa, Artificial Sequence
  derived and/or modified protein sequence (wt) from Lassa virus__AIT17345__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLSMIGMSSGVQGARAGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISETPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIKKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 269 - protein, 569 aa, Artificial Sequence
  derived and/or modified protein sequence (wt) from Lassa virus__AIT17351__NP
MSASKEIKSFLWTQSLRRELSGYCSNIKLQVVKDAQALLHGLDFSEVSNVQRLMRKQRRDDGDLKRLRDLNQAVNNLVELKSTQQKSVLRVGTLTSDDLLILAADLEKLKSKVIRTERPLSAGVYMGNLSSQQLEQRRALLNMIGMSSGNQGARTGKDGVVRIWDVKNADLLNNQFGTMPSLTLACLTKQGQVDLNDVVQALTDLGLIYTAKYPNTSDLDRLTQSHPILNMVDTSKSSLNISGYNFSLGAAVKAGACMLDGGNMLETIKVSPQTMDGILKSILKVKKSLGMFVSDTPGERNPYENILYKICLSGDGWPYIASRTSITGRAWENTVVDLESNGKPQKAGSNNSNKSLQSTGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDTLPRNMVITCQGSDDIRKLLESQGRKDIKLIDIALSKIDSRKYENAVWDQYKDLCHMHTGVVVEKKKRGGKEEITPHCALMDCIMFDAAVSGGLNASVLRAVLPRDMVFRTSTPRVVL

SEQ ID NO: 270 - protein, 569 aa, Artificial Sequence
  derived and/or modified protein sequence (wt) from Lassa virus__AIT17359__NP
MSASKEIKSFLWTQSLRRELSGYCSNIKLQVVKDAQALLHGLDFSEVSNVQRLMRKERRDDSDLKRLRDLNQAVNNLVELKSTQQKSILRVGTLTSDDLLILAADLEKLKSKVTRTERPLSAGVYMGNLSSQQLDQRRALLNMLGMSGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDEKPQKAGSNSSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNASVLRAVLPRDMVFRTSTPRVVL

SEQ ID NO: 271 - protein, 569 aa, Artificial Sequence
  derived and/or modified protein sequence (wt) from Lassa virus__AIT17361__NP
MSASKEIKSFLWTQSLRRELSGYCSNIKLQVVKDAQALLHGLDFSEVSNVQRLMRKERRDDSDLKRLRDLNQAVNNLVELKSTQQKSVLRVGTLTSDDLLVLAADLEKLKSKVTRTERPLSAGVYMGNLSSQQLDQRRALLNMIGMSGGNQGARAGRDGVVRIWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTIVDLESDGKPQKTNNTNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDTLPRNMVITCQGSEDIRRLLESQGRKDIKLIDIALSKTDSRKYENAVWDQYKDLCHMHTGVVVEKKKKGGKEEITPHCALMDCIMFDAAVSGGLNTSVLRAVLPRDMVFRTSTPRVVL

SEQ ID NO: 272 - protein, 569 aa, Artificial Sequence
  derived and/or modified protein sequence (wt) from Lassa virus__AIT17365__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGAQAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDAPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLFESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 273 - protein, 569 aa, Artificial Sequence
  derived and/or modified protein sequence (wt) from Lassa virus__AIT17371__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGAQAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDAPGERNPYENILYKICLSGDGWPYIASRTSITGRAWENTVVDLESDGKPQKAGSNSSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLFESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 274 - protein, 569 aa, Artificial Sequence
  derived and/or modified protein sequence (wt) from Lassa virus__AIT17379__NP
MSASKEIKSFLWTQSLRRELSGYCSNIKLQVVKDAQALLHGLDFSEVSNVQRLMRKERRDDSDLKRLRDLNQAVNNLVELKSTQQKSVLRVGTLTSDDLLILAADLEKLKSKVTRTERPLSAGVYMGNLSSQQLDQRRALLNMIGMSSGNRGAQAGRDGVVRVWDVKNAELLNNQFGTMPSLTLACLTKQGQVDLNDAVQALTDLGLIYTAKYPNTSDLDRLTQSHPILNMVDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 275 - protein, 569 aa, Artificial Sequence
  derived and/or modified protein sequence (wt) from Lassa virus__AIT17381__NP
MSASKEIKSFLWTQSLRRELSGYCSNIKLQVVKDAQALLHGLDFSEVSNVQRLMRKERRDDSDLKRLRDLNQAVNNLVELKSTQQKSVLRVGTLTSDDLLVLAADLEKLKSKVTRTERPLSAGVYMGNLSSQQLDQRRALLSMIGMSGGNQGARAGRDGVVRIWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTIVDLESDGKPQKTSNTNSNKSLQSAGFAAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSEDIRKLLESQGRKDIKLIDIALSKTDSRKYENAVWDQYKDLCHMHTGVVVEKKKKGGKEEITPHCALMDCIMFDAAVSGGLNTSVLRAVLPRDMVFRTSTPRVVL

SEQ ID NO: 276 - protein, 569 aa, Artificial Sequence
  derived and/or modified protein sequence (wt) from Lassa virus__AIT17389__NP
MSASKEIKSFLWTQSLRRELSGYCSNIKLQVVKDAQALLHGLDFSEVSNVQRLMRKQRRDDGDLKRLRDLNQAVNNLVELKSTQQKSVLRVGTLTSDDLLILAADLEKLKSKVTRTERPLSAGVYMGNLSSQQLDQRRALLNMIGMSGGNQGARTGKDGVVRIWDVKNADLLNNQFGTMPSLTLACLTKQGQVDLNDVVQALTDLGLIYTAKYPNTSDLDRLTQSHPILNMIDTSKSSLNISGYNFSLGAAVKAGACMLDGGNMLETIKVSPQTMDGILKSILKVKKSLGMFISDTPGERNPYENILYKICLSGDGWPYIASRTSITGRAWENTVVDLESDGKPQKAGSNNSNKSLQSTGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDTLPRNMVITCQGSDDIRKLLESQGRKDIKLIDIALSKTDSRKYENAVWDQYKDLCHMHTGVVVEKKKRGGKEEITPHCALMDCIMFDAAVSGGLNVSVLRAVLPRDMVFRTSTPRVVL

SEQ ID NO: 277 - protein, 569 aa, Artificial Sequence
  derived and/or modified protein sequence (wt) from Lassa virus__AIT17399__NP
MSASKEIKSFLWTQSLRRELSGYCSNIKLQVVKDAQALLHGLDFSEVSNVQRLMRKQRRDDSDLKRLRDLNQAVNNLVELKSTQQKSVLRVGTLTSDDLLVLAADLEKLKSKVIRTERPLSSGVYMGNLSSQQLDQRRALLNMIGMSGGNQGAQVGRDGVVRVWDVKNADLLNNQFGTMPSLTLACLTKQGQVDLNDVVQALTDLGLIYTAKYPNTSDLDRLAQSHPILNMIDTKKSSLNISGYNFSLGAAVKAGACMLDGGNMLETIKVTPQTMDGILKSILKVKKALGMFISETPGERNPYENILYKICLSGDGWPYIASRTSITGRAWENTVVDLESDGKPQKAGNNNSNKSLQSAGFTAGLTYSQLMTLKDSMLQLDPNAKTWMDIEGRPEDPVEVALYQPSSGCYIHFFREPTDLKQFKQDAKYSHGIDVTDLFATQPGLTSAVIEALPRNMVITCQGSDDIRKLLESQGRKDIKLIDIALNKTDSRKYENAVWDQYKDLCHMHTGVVVEKKKRGGKEEITPHCALMDCIMFDAAVSGGLKTLALRAVLPRDMVFRTSTPKVVL

SEQ ID NO: 278 - protein, 569 aa, Artificial Sequence
  derived and/or modified protein sequence (wt) from Lassa virus__AIT17405__NP
MSVSKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDIKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGSAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 279 - protein, 569 aa, Artificial Sequence
  derived and/or modified protein sequence (wt) from Lassa virus__AIT17409__NP
MSASKEVKSFLWTQSLRRELSGYCSNIKLQVVKDAQALLHGLDFSEVSNVQRLMRKQKRDDGDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFSAQPGLTSAVIEALPRNMVLTCQGSDDIKRLLDSQGRRDIKLIDIALNKADSRRFENAVWDQCKDLCHMHTGVVVEKKKRGGKEEITPHCALMDCIMYDAAVSGGLNIPVLRAVLPRDMVFRTSSPKVVL

SEQ ID NO: 280 - protein, 569 aa, Artificial Sequence
  derived and/or modified protein sequence (wt) from Lassa virus__AIT17413__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDAPGERNPYENILYKICLSGDGWPYIASRTSIVGRAWENTTVDLESDGKPQKMGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 281 - protein, 569 aa, Artificial Sequence
  derived and/or modified protein sequence (wt) from Lassa virus__AIT17421__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVSGAQGTQPGRDGVVRVWDVKNPDLLNNQFGTMPSLTLACLTKQGQVDLNDAVLALTDLGLIYTAKYPNSSDLDRLSQSHPILNMVDIKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKMGSAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 282 - protein, 569 aa, Artificial Sequence
  derived and/or modified protein sequence (wt) from Lassa virus__AIT17425__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTIVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 283 - protein, 569 aa, Artificial Sequence
  derived and/or modified protein sequence (wt) from Lassa virus__AIT17429__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSAQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDAPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 284 - protein, 569 aa, Artificial Sequence
  derived and/or modified protein sequence (wt) from Lassa virus__AIT17431__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTASPKVVL

SEQ ID NO: 285 - protein, 569 aa, Artificial Sequence
  derived and/or modified protein sequence (wt) from Lassa virus__AIT17439__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKMGTAGSNKSLQSAGFPTGLTYSQLMTLKDSMMQLDPSAKTWIDIEGRPEDPVEIALYQPVSGCYIHFFREPTDLKQFKQDAKYSHGIDVADLFSAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVFRAVLPRDMVFRTSSPKVVL

SEQ ID NO: 286 - protein, 569 aa, Artificial Sequence
  derived and/or modified protein sequence (wt) from Lassa virus__AIT17443__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDAPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 287 - protein, 569 aa, Artificial Sequence
  derived and/or modified protein sequence (wt) from Lassa virus__AIT17447__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTTGSNKSLQSAGFPTGLTYSQLMTLKDSMMQLDPSAKTWIDIEGRPEDPVEIALYQPMSGCYIHFFREPTDLKQFKQDAKYSHGIDVTDLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 288 - protein, 569 aa, Artificial Sequence
  derived and/or modified protein sequence (wt) from Lassa virus__AIT17451__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKFPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTTGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 289 - protein, 569 aa, Artificial Sequence
  derived and/or modified protein sequence (wt) from Lassa virus__AIT17455__NP
MSASKEVKSFLWTQSLRRELSGYCSSIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSTQQLEQRRALLSMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 290 - protein, 569 aa, Artificial Sequence
  derived and/or modified protein sequence (wt) from Lassa virus__AIT17459__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKMGTAGSNKSLQSAGFPTGLTYSQLMTLKDSMMQLDPSAKTWIDIEGRPEDPVEIALYQPVSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 291 - protein, 569 aa, Artificial Sequence
  derived and/or modified protein sequence (wt) from Lassa virus__AIT17463__NP
MSASKEVKSFLWTQSLRRELSGYCSSIKLQVVKDAQALLHGLDFSEVSNVQRLMRKHKRDDSDLKRLRDLNQAVNNLVELKSTQQKSILRVGTLTSDDLLTLAADLEKLKSKVIRTERPLSSGVYMGNLSTQQLEQRRALLNMIGMVGGAQSTQPGRDGVVRVWDVKNPDLLNNQFGTMPSLTLACLTKQGQVDLNDAVLALTDLGLIYTAKYPNSSDLDRLSQSHPILTMVDTKKSSLNISGFNFSLGAAVKAGACMLDGGNMLETIKVTPQTMDGILKSILKVKKSLGMFVSDTPGERNPYENILYKICLSGDGWPYIASRTSIVGRAWENTIVDLETDGKPQKVGTAGSSRSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 292 - protein, 569 aa, Artificial Sequence
  derived and/or modified protein sequence (wt) from Lassa virus__AIT17467__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGTQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDISLSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 293 - protein, 569 aa, Artificial Sequence
  derived and/or modified protein sequence (wt) from Lassa virus__AIT17471__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKMGTTGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRKFENVVWDQCKDLCHMHTGVVVEKKKRGGKEEITPHCALMDCIMYDAAVSGGLNIPVLRAVLPRDMVFRTSSPKVVL

SEQ ID NO: 294 - protein, 569 aa, Artificial Sequence
  derived and/or modified protein sequence (wt) from Lassa virus__AIT17475__NP
MSASKEVKSFLWTQSLRRELSGYCSSIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSAQQLEQRRALLSMIGMVGGAQGTQPGRDGVVRVWDVKNPDLLNNQFGTMPSLTLACLTKQGQVDLNDTVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPISGCYIHFFREPTDLKQFKQDAKYSHGIDVTDLFPAQPGLTSAVIEALPRNMVLTCQGSDDIKRLLDSQGRRDIKIIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 295 - protein, 569 aa, Artificial Sequence
  derived and/or modified protein sequence (wt) from Lassa virus__AIT17479__NP
MSASKEVKSFLWTQSLRRELSGYCSNIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRKDIKLIDIALSKVDSRRFENAVWDQCKDLCHMHTGVVVEKKKRGGKEEITPHCALMDCIMYDAAVSGGLNIPVLRAVLPRDMVFRTSSPKVVL

SEQ ID NO: 296 - protein, 569 aa, Artificial Sequence
  derived and/or modified protein sequence (wt) from Lassa virus__AIT17491__NP
MSASKEVKSFLWTQSLRRELSGYCSNIKLQVVKDAQALLHGLDFSEVSNVQRLMRKQKRDDGDLKRLRDLNQAVNNLVELKSTQQKSVLRVGTLTSDDLLTLAADLEKLKSKVIRTERPLSSGVYMGNLSTQQLEQRRALLSMIGMVGGARGTQPGRDGVVRVWDVKNPDLLNNQFGTMPSLTLACLTKQGQVDLNDVVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGAAGSNKSLQSAGFPTGLTYSQLMTLKDSMMQLDPSAKTWIDIEGRPEDPVEIALYQPMSGCYIHFFREPTDLKQFKQDAKYSHGIDVTDLFSAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 297 - protein, 569 aa, Artificial Sequence
  derived and/or modified protein sequence (wt) from Lassa virus__AIT17495__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQSAQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKRSLGMFVSDAPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 298 - protein, 569 aa, Artificial Sequence
  derived and/or modified protein sequence (wt) from Lassa virus__AIT17499__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNIIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGAAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDVKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 299 - protein, 569 aa, Artificial Sequence
  derived and/or modified protein sequence (wt) from Lassa virus__AIT17503__NP
MSSSKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSAQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 300 - protein, 569 aa, Artificial Sequence
  derived and/or modified protein sequence (wt) from Lassa virus__AIT17507__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNLIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTIDGILKSILKVKKSLGMFVSDTPGERNPYENILYKICLSGDGWPYIASRTSIVGRAWENTTVDLESDGKPHKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKVDSRRFENAVWDQCKDLCHMHTGVVVEKKKRGGKEEITPHCALMDCIMYDAAVSGGLNIPVLRAVLPRDMVFRTSSPKVVL

SEQ ID NO: 301 - protein, 569 aa, Artificial Sequence
  derived and/or modified protein sequence (wt) from Lassa virus__AIT17511__NP
MSASKEVKSFLWTQSLRRELSGYCSNIKLQVVKDAQALLHGLDFSEVSNVQRLMRKQKRDDGDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTIDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFSAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 302 - protein, 569 aa, Artificial Sequence
  derived and/or modified protein sequence (wt) from Lassa virus__AIT17515__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGAAGSSKSLQSAGFPTGLTYSQLMTLKDSMMQLDPSAKTWIDIEGRPEDPVEIALYQPVSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 303 - protein, 569 aa, Artificial Sequence
  derived and/or modified protein sequence (wt) from Lassa virus__AIT17519__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSAQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 304 - protein, 569 aa, Artificial Sequence
  derived and/or modified protein sequence (wt) from Lassa virus__AIT17525__NP
MSASKEVKSFLWTQSLRRELSGYCSSIKLQVVKDAQALLHGLDFSEVSNVQRLMRKQRRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTVDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPTQPGLTSAVIEALPRNMVLTCQGSDDIKRLLDSQGRRDIKLIDIALSKADSRKFENAVWDQCKDLCHMHTGVVVEKKKRGGKEEITPHCALMDCIMYDAAVSGGLNIPVLRAVLPRDMVFRTSSPKVVL

SEQ ID NO: 305 - protein, 569 aa, Artificial Sequence
  derived and/or modified protein sequence (wt) from Lassa virus__AIT17533__NP
MSASKEVKSFLWTQSLRRELSGYCSNIKLQVVKDAQALLHGLDFSEVNNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMAGGTQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDISLSKIDSRKFENAVWDQCKDLCHMHTGVVVEKKKRGGKEEITPHCALMDCIMFDAAVSGGLNIPVLRAVLPRDMVFRTSSPKVVL

SEQ ID NO: 306 - protein, 569 aa, Artificial Sequence
  derived and/or modified protein sequence (wt) from Lassa virus__AIT17539__NP
MSASKEVKSFLWTQSLRRELSGYCSNIKLQVVKDAQALLHGLDFSEVSNVQRLMRKQKRDDGDLKRLRDLNQAVNNLVELKSTQQKSVLRVGTLTSDDLLILAADLEKLKSKVIRTERPLSSGVYMGNLSTQQLEQRKALLSMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGSAGSNKSLQSAGFPTGLTYSQLMTLKDSMMQLDPSAKTWIDIEGRPEDPVEIALYQPMSGCYIHFFREPTDLKQFKQDAKYSHGIDVTDLFSAQPGLTSAVIEALPRNMVLTCQGSDDIKKLLDSQGRRDIKLIDISLGKADSRRFENAVWDQCKDLCHMHTGVVVEKKKRGGKEEITPHCALMDCIMFDAAVSGGLNIPILRAVLPRDMVFRTSSPKVVL

SEQ ID NO: 307 - protein, 569 aa, Artificial Sequence
  derived and/or modified protein sequence (wt) from Lassa virus__AIT17541__NP
MSASKEVKSFLWTQSLRRELSGYCSNIKLQVVKDAQALLHGLDFSEVSNVQRLMRKQKRDDGDLKRLRDLNQAVNNLVELKSTQQKSVLRVGTLSSDDLLTLAADLEKLKSKVIRTERPLSSGVYMGNLSSQQLDQRRALLNMIGMTSDRQGASTGRDGIVRVWDVKNAELLNNQFGTVPSLTLACLTKQGQVDLNDAVQALTDLGLIYTAKYPNSSDLDRLSQSHPILNMIDTKKSSLNISGYNFSLGAAVKAGACMLDGGNMLETIKVSPQTMDGILKSILKVKRSLGMFVSDIPGERNPYENILYKICLSGDGWPYIASRTSITGRAWENTIVDLESDSKPQKPGNSGSNRSLQSAGFPAGLTYSQLMTLKDSMLQLDPNAKTWMDIEGRPDDPVEIALYQPSSGCYIHFFREPTDLKQFKQDAKYSHGIDVGDLFAAQPGLTSAVIEALPRNMVITCQGSEDIKKLLESQGRKDIKLVDISMSKPDSRKFENAVWDQYKDLCHMHTGIVVEKKKRGGKEEITPHCALMDCIMFDAAVVGGLDARILRAVLPRDMVFRTSTPKVVL

SEQ ID NO: 308 - protein, 569 aa, Artificial Sequence
  derived and/or modified protein sequence (wt) from Lassa virus__AIT17545__NP
MSASKEVKSFLWTQSLRRELSGYCSNIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGIAGSNKSLQSAGFPTGLTYSQLMTLKDSMMQLDPSAKTWIDIEGRPEDPVEIALYQPMSGCYIHFFREPTDLKQFKQDAKYSHGIDVADLFSAQPGLTSAVIEALPRNMVLTCQGSDDIKRLLDSQGRRDIKLIDIALSKADSRKFENAVWDQCKDLCHMHTGVVVEKKKRGGKEEITPHCALMDCIMYDAAVSGGLDIPVLRAVLPRDMVFRTSSPKVVL

SEQ ID NO: 309 - protein, 569 aa, Artificial Sequence
  derived and/or modified protein sequence (wt) from Lassa virus__AIT17549__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDVVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTVGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRKFENAVWDQCKDLCHMHTGVVVEKKKRGGKEEITPHCALMDCIMYDAAVSGGLNIPVLRAVLPRDMVFRTSSPKVVL

SEQ ID NO: 310 - protein, 569 aa, Artificial Sequence
  derived and/or modified protein sequence (wt) from Lassa virus__AIT17553__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKMGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 311 - protein, 569 aa, Artificial Sequence
  derived and/or modified protein sequence (wt) from Lassa virus__AIT17561__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTIDGILKSILKVKKSLGMFVSDTPGERNPYENILYKICLSGDGWPYIASRTSIVGRAWENTTVDLESDGKPQKVGTVGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKRRGGKEEITPHCALMDCIMYDAAVSGGLNIPVLRAVLPRDMVFRTSSPKVVL

SEQ ID NO: 312 - protein, 569 aa, Artificial Sequence
  derived and/or modified protein sequence (wt) from Lassa virus__AIT17565__NP
MSASKEIKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDAPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRKFENAVWDQCKDLCHMHTGVVVEKKKRGGKEEITPHCALMDCIMYDAAVSGGLNIPVLRAVLPRDMVFRTSSPKVVL

SEQ ID NO: 313 - protein, 569 aa, Artificial Sequence
  derived and/or modified protein sequence (wt) from Lassa virus__AIT17569__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKFPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTTGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNLPVLRAVLPRDMVFRTSSPKVVL

SEQ ID NO: 314 - protein, 569 aa, Artificial Sequence
  derived and/or modified protein sequence (wt) from Lassa virus__AIT17573__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDIADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 315 - protein, 569 aa, Artificial Sequence
  derived and/or modified protein sequence (wt) from Lassa virus__AIT17577__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIAGRAWENTTVDLESDGKPQKVGAAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCRDLCHMHTGVVVEKKKRGGKEEITPHCALMDCIMYDAAVSGGLNIPVLRAVLPRDMVFRTSSPKVVL

SEQ ID NO: 316 - protein, 569 aa, Artificial Sequence
  derived and/or modified protein sequence (wt) from Lassa virus__AIT17581__NP
MSASKEVKSFLWTQSLRRELSGYCSSIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSAQQLEQRRTLLNMIGMVGGAQGTQPGRDGVVRVWDVKNPDLLNNQFGTMPSLTLACLTKQGQVDLNDVVLALTDLGLIYTAKYPNSSDLDRLSQSHPILSMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 317 - protein, 569 aa, Artificial Sequence
  derived and/or modified protein sequence (wt) from Lassa virus__AIT17589__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSAQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTTGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRKFENAVWDQCKDLCHMHTGVVVEKKKRGGKEEITPHCALMDCIMYDAAVSGGLNIPVLRAVLPRDMVFRTSSPKVVL

SEQ ID NO: 318 - protein, 569 aa, Artificial Sequence
  derived and/or modified protein sequence (wt) from Lassa virus__AIT17593__NP
MSASKEVKSFLWTQSLRRELSGYCSSIKLQVVKDAQALLHGLDFSEVSNVQRLMRKQKRDDGDLKRLRDLNQAVNNLVELKSTQQKSILRVGTLTSDDLLTLAADLEKLKSKVIRTERPLSSGVYMGNLSSQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGAAGSTKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKVDSRRFENAVWDQCKDLCHMHTGVVVEKKKRGGKEEITPHCALMDCIMYDAAVSGGLNIPVLRAVLPRDMVFRTSSPKVVL

SEQ ID NO: 319 - protein, 569 aa, Artificial Sequence
  derived and/or modified protein sequence (wt) from Lassa virus__AIT17605__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMAGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFSAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 320 - protein, 569 aa, Artificial Sequence
  derived and/or modified protein sequence (wt) from Lassa virus__AIT17609__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMAGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGAAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 321 - protein, 569 aa, Artificial Sequence
  derived and/or modified protein sequence (wt) from Lassa virus__AIT17613__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKTDSRRFENAVWDQCKDLCHMHTGVVVEKKKRGGKEEITPHCALMDCIMYDAAVSGGLNIPVLRAVLPRDMVFRTSSPKVVL

SEQ ID NO: 322 - protein, 569 aa, Artificial Sequence
  derived and/or modified protein sequence (wt) from Lassa virus__AIT17617__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSAQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 323 - protein, 569 aa, Artificial Sequence
  derived and/or modified protein sequence (wt) from Lassa virus__AIT17621__NP
MSASKEVKSFLWTQSLRRELSGYCSSIKLQVVKDAQALLHGLDFSEVTNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGIAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRKFENAVWDQCKDLCHMHTGVVVEKKKRGGKEEITPHCALMDCIMYDAAVSGGLNIPVLRAVLPRDMVFRTSSPKVVL

SEQ ID NO: 324 - protein, 569 aa, Artificial Sequence
  derived and/or modified protein sequence (wt) from Lassa virus__AIT17625__NP
MSASKEVKSFLWTQSLRRELSGYCSSIKLQVVKDAQALLHGLDFSEVSNVQRLMRKQRRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTVDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRKFENAVWDQCKDLCHMHTGVVVEKKKRGGKEEITPHCALMDCIMYDAAVSGGLNIPVLRAVLPRDMVFRTSSPKVVL

SEQ ID NO: 325 - protein, 569 aa, Artificial Sequence
  derived and/or modified protein sequence (wt) from Lassa virus__AIT17627__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSSQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGSAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 326 - protein, 569 aa, Artificial Sequence
  derived and/or modified protein sequence (wt) from Lassa virus__AIT17631__NP
MSASKEIKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDAPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 327 - protein, 569 aa, Artificial Sequence
  derived and/or modified protein sequence (wt) from Lassa virus__AIT17635__NP
MSASKEVKSFLWTQSLRRELSGYCSNIKLQVVKDAQALLHGLDFSEVSNVQRLMRKQKRDDNDLKRLRDLNQAVNNLVELKSTQQKSILRVGTLTSDDLLTLAADLEKLKSKVIRTERPLSSGVYMGNLNTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 328 - protein, 569 aa, Artificial Sequence
  derived and/or modified protein sequence (wt) from Lassa virus__AIT17639__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDIKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGSAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 329 - protein, 569 aa, Artificial Sequence
  derived and/or modified protein sequence (wt) from Lassa virus__AIT17643__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSAQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 330 - protein, 569 aa, Artificial Sequence
  derived and/or modified protein sequence (wt) from Lassa virus__AIT17651__NP
MSASKEVKSFLWTQSLRRELSGYCSSIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSAQQLEQRRALLNMIGMVGGAQGTQPGRDGVVRVWDVKNPDLLNNQFGTMPSLTLACLTKQGQVDLNDVVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFSAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 331 - protein, 569 aa, Artificial Sequence
  derived and/or modified protein sequence (wt) from Lassa virus__AIT17655__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTEKPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKFPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTTGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 332 - protein, 569 aa, Artificial Sequence
  derived and/or modified protein sequence (wt) from Lassa virus__AIT17659__NP
MSASKEVKSFLWTQSLRRELSGYCSSIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSTQQLEQRRALLSMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALNKADSRRFENAVWDQCKDLCHMHTGVVVEKKKRGGKEEITPHCALMDCIMYDAAVSGGLNIPVLRAVLPRDMVFRTSSPKVVL

SEQ ID NO: 333 - protein, 569 aa, Artificial Sequence
  derived and/or modified protein sequence (wt) from Lassa virus__AIT17663__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKKLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 334 - protein, 569 aa, Artificial Sequence
  derived and/or modified protein sequence (wt) from Lassa virus__AIT17667__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTIDGILKSILKVKKSLGMFVSDTPGERNPYENILYKICLSGDGWPYIASRTSIVGRAWENTTVDLESDGKPQKVGTTGSNKSLQSAGFPTGLTYSQLMTLKDSMMQLDPSAKTWIDIEGRPEDPVEIALYQPMSGCYIHFFREPTDLKQFKQDAKYSHGIDVTDLFPAQPGLTSAVIEALPRNMVLTCQGSEDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 335 - protein, 569 aa, Artificial Sequence
  derived and/or modified protein sequence (wt) from Lassa virus__AIT17671__NP
MSASKEVKSFLWTQSLRRELSGYCSSIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDVVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 336 - protein, 569 aa, Artificial Sequence
  derived and/or modified protein sequence (wt) from Lassa virus__AIT17675__NP
MSASKEVKSFLWTQSLRRELSGYCSSIKLQVVKDAQALLHGLDFSEVSNVQRLMRKQKRDDSDLKRLRDLNQAVNNLVELKSTQQKSVLRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTIVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 337 - protein, 569 aa, Artificial Sequence
  derived and/or modified protein sequence (wt) from Lassa virus__AIT17679__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQSTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 338 - protein, 569 aa, Artificial Sequence
  derived and/or modified protein sequence (wt) from Lassa virus__AIT17683__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 339 - protein, 569 aa, Artificial Sequence
  derived and/or modified protein sequence (wt) from Lassa virus__AIT17687__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSAQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 340 - protein, 569 aa, Artificial Sequence
  derived and/or modified protein sequence (wt) from Lassa virus__AIT17695__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNLIGMVGGAQGTQPGRDGVVRVWDVKNPDLLNNQFGTMPSLTLACLTKQGQVDLNDVVLALTDLGLIYTAKYPNSSDLDRLSQSHPILNMVDTKKSSLNISGFNFSLGAAVKAGACMLDGGNMLETIKVTPHTMDGILKSILKVKKSLGMFVSDTPGERNPYENILYKICLSGDGWPYIASRTSIVGRAWENTTVDLESDGKPHKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 341 - protein, 569 aa, Artificial Sequence
  derived and/or modified protein sequence (wt) from Lassa virus__AIT17705__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNLIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKKSLGMFVSDTPGERNPYENILYKICLSGDGWPYIASRTSIVGRAWENTTVDLESDGKPHKVGTAGSNRSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 342 - protein, 569 aa, Artificial Sequence
  derived and/or modified protein sequence (wt) from Lassa virus__AIT17711__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNLIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGFNFSLGAAVKAGACMLDGGNMLETIKVTPQTMDGILKSILKVKKSLGMFVSDTPGERNPYENILYKICLSGDGWPYIASRTSIVGRAWENTTVDLESDGKPHKVGTAGSSKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 343 - protein, 569 aa, Artificial Sequence
  derived and/or modified protein sequence (wt) from Lassa virus__AIT17713__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDIKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALNKADSRRFENAVWDQCKDLCHMHTGVVVEKKKRGGKEEITPHCALMDCIMYDAAVSGGLNIPVLRAVLPRDMVFRTSSPKVVL

SEQ ID NO: 344 - protein, 569 aa, Artificial Sequence
  derived and/or modified protein sequence (wt) from Lassa virus__AIT17719__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVSGAQGTQPGRDGVVRVWDVKNPELLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDISLSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 345 - protein, 569 aa, Artificial Sequence
  derived and/or modified protein sequence (wt) from Lassa virus__AIT17725__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSAQQLEQRRALLNMIGMVGGAQGTQLGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSEDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 346 - protein, 569 aa, Artificial Sequence
  derived and/or modified protein sequence (wt) from Lassa virus__AIT17729__NP
MSASKEVKSFLWTQSLRRELSGYCSSIKLQVVKDAQALLHGLDFSEVSNVQRLMRKQRRDDSDLKRLRDLNQAVNNLVELKSTQQKSILRVGTLTSDDLLTLAADLEKLKSKVIRTERPLSSGVYMGNLSTQQLEQRRALLNMIGMVGGTQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRKFENAVWDQCKDLCHMHTGVVVEKKKRGGKEEITPHCALMDCIMYDAAVSGGLNIPVLRAVLPRDMVFRTSSPKVVL

SEQ ID NO: 347 - protein, 569 aa, Artificial Sequence
  derived and/or modified protein sequence (wt) from Lassa virus__AIT17733__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLILAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 348 - protein, 569 aa, Artificial Sequence
  derived and/or modified protein sequence (wt) from Lassa virus__AIT17745__NP
MSASKEIKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDAPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKVDSRRFENAVWDQCKDLCHMHTGVVVEKKKRGGKEEITPHCALMDCIMYDAAVSGGLNIPVLRAVLPRDMVFRTSSPKVVL

SEQ ID NO: 349 - protein, 569 aa, Artificial Sequence
  derived and/or modified protein sequence (wt) from Lassa virus__AIT17753__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKPQKVGTTGSNKSLQSAGFPTGLTYSQLMTLKDSMMQLDPSAKTWIDIEGRPEDPVEIALYQPMSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 350 - protein, 569 aa, Artificial Sequence
  derived and/or modified protein sequence (wt) from Lassa virus__AIT17763__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTVDGILKSILKVKRSLGMFVSDTPGERNPYENILYKICLSGDGWPYIASRTSIVGRAWENTTVDLESDEKPQKVGAAGSNKSLQSAGFPTGLTYSQLMTLKDSMMQLDPSAKTWIDIEGRPEDPVEIALYQPMSGCYIHFFREPTDLKQFKQDAKYSHGIDVTDLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 351 - protein, 569 aa, Artificial Sequence
  derived and/or modified protein sequence (wt) from Lassa virus__AIT17771__NP
MSASKEVKSFLWTQSLRRELSGYCSSIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKRSLGMFVSDTPGERNPYENILYKICLSGDGWPYIASRTSIVGRAWENTTVDLESDGKTQKVSTAGSNKSLQSAGFPTGLTYSQLMTLKDSMMQLDPSAKTWIDIEGRPEDPVEIALYQPMSGCYIHFFREPTDLKQFKQDAKYSHGIDVTDLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 352 - protein, 569 aa, Artificial Sequence
  derived and/or modified protein sequence (wt) from Lassa virus__AIT17779__NP
MSASKEVKSFLWTQSLRRELSGYCSNIKLQVVKDAQALLHGLDFSEVSNVQRLMRKQKRDDGDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFSAQPGLTSAVIEALPRNMVLTCQGSDDIKRLLDSQGRRDIKLIDIALSKTDSRRFENAVWDQCKDLCHMHTGVVVEKKKRGGKEEITPHCALMDCIMYDAAVSGGLNIPVLRAVLPRDMVFRTSSPKVVL

SEQ ID NO: 353 - protein, 569 aa, Artificial Sequence
  derived and/or modified protein sequence (wt) from Lassa virus__AIT17783__NP
MSASKEVKSFLWTQSLRRELSGYCSNIKLQVVKDAQALLHGLDFSEVSNVQRLMRKQKRDDSDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDVVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPVSGCYIHFFREPTDLKQFKQDAKYSHGIDVADLFPAQPGLTSAVIEALPRNMVLTCQGSDDIKRLLDSQGRRDIKLIDIALSKADSRRFENAVWDQCKDLCHMHTGVVVEKKKRGGKEEITPHCALMDCIMYDAAVSGGLNIPVLRAVLPRDMVFRTSSPKVVL

SEQ ID NO: 354 - protein, 569 aa, Artificial Sequence
  derived and/or modified protein sequence (wt) from Lassa virus__AIT17787__NP
MSASKEVKSFLWTQSLRRELSGYCSNIKLQVVKDAQALLHGLDFSEVSNVQRLMRKQKRDDGDLKRLRDLNQAVNNLVELKSTQQKSILRVGTLTSDDLLTLAADLEKLKSKVIRTERPLSSGVYMGNLSTQQLEQRRALLNMIGMVGGAQGTQPGRDGVVRVWDVKNPDLLNNQFGTMPSLTLACLTKQGQVDLNDAVLALTDLGLIYTAKYPNSSDLDRLSQSHPILNMVDTKKSSLNISGYNFSLGAAVKAGACMLDGGNMLETIKVTPQTMDGILKSILKVKKSLGMFVSDTPGERNPYENILYKICLSGDGWPYIASRTSIVGRAWENTTVDLESDGKPQKVGTAGSNKSLQSAGFPTGLTYSQLMTLKDSMMQLDPSAKTWIDIEGRPEDPVEIALYQPMSGCYIHFFREPTDLKQFKQDAKYSHGIDVTDLFSAQPGLTSAVIEALPRNMVLTCQGSDDIKRLLDSQGRRDIKLIDIALSKVDSRRFENAVWDQCKDLCHMHTGVVVEKKKRGGKEEITPHCALMDCIMYDAAVSGGLNIPVLRAVLPRDMVFRTSSPKVVL

SEQ ID NO: 355 - protein, 569 aa, Artificial Sequence
  derived and/or modified protein sequence (wt) from Lassa virus__AIT17803__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLSMIGMSGGSQEARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTVDGILKSILKVKKALGMFISDTPGERNPYENILYKICLSGDGWPYIASRTSITGRAWENTVVDLESDGKPQKAGSNNSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKKGGKEEITPHCALMDCIMFDAAVSGGLNTSVLRAVLPRDMVFRTSTPRVVL

SEQ ID NO: 356 - protein, 569 aa, Artificial Sequence
  derived and/or modified protein sequence (wt) from Lassa virus__AIT17811__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIAFYQPSSGCYIHFFREPTDLKQFKQDAKYSHGIDVTDLFAAQPGLTSAVIDALPRNLVITCQGSDDIRKLFESQGRKDIKLIDIALSKTDSRKYENAVWDQYKDLCHMHTGIVVEKKKRGGKEEITPHCALMDCIMFDAAVSGGLNASVLRAVLPRDMVFRTSTPRVVL

SEQ ID NO: 357 - protein, 569 aa, Artificial Sequence
  derived and/or modified protein sequence (wt) from Lassa virus__AIT17815__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLDMIGMSGSNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDAPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLFESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 358 - protein, 569 aa, Artificial Sequence
  derived and/or modified protein sequence (wt) from Lassa virus__AIT17821__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLSMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTVDGILKSILKVKKALGMFISDTPGERNPYENILYKICLSGDGWPYIASRTSITGRAWENTVVDLESDGKPQKTGSNNSNKSLQSAGFTAGLTYSQLMTLKDAMLQLDPNAKTWMDIEGRPEDPVEVALYQPSSGCYIHFFREPTDLKQFKQDAKYSHGIDVTDLFAAQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 359 - protein, 569 aa, Artificial Sequence
  derived and/or modified protein sequence (wt) from Lassa virus__AIT17837__NP
MSNSKEIKSFLWTQSLRRELSGYCSNIKLQVVKDAQALLHGLDFSEVSNVQRLMRKQKRDDADLKRLRDLNQAVNNLVELKSTQQKNVLRVGTLSSDDLITLAADLEKLKSKVIRTERPLSSGVYMGNLSSQQLDQRRALLSMIGMSGGPQGNRTGGDGVVRVWDVKNAELLNNQFGTMPSLTLACLTKQGQVDLNDAVQALTDLGLIYTAKYPNSSDLDMLTQSHPILGMVDTKKSSLNISGYNFSLGAAVKAGACMLDGGNMLETIKVSPQTMDGILKSILKVKRSLGMFISDTPGERNPYENILYKICLSGEGWPYIASRTSITGRAWENTLVDLESDNKPPKLNSAGSNKSLQAAGLNAGLTYSQLMTLKDCMLQLDPSSKTWIDIEGRPEDPVEIALFQPSSGCYIHFFREPTDLKQFKQDAKYSHGIDVTDLFSTQPGLTSAVIEALPRNMVLTCQGSDDIKKLLESQGRRDIKLIDISLSKADSRKFENAVWDQYKDLCHMHTGVVVEKKKRGGKEEITPHCALLDCIMFDAATTGSLNITTLRAVLPRDMVFRTSTPKVVL

SEQ ID NO: 360 - protein, 569 aa, Artificial Sequence
  derived and/or modified protein sequence (wt) from Lassa virus__AIT17841__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGARTGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDAPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLFESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 361 - protein, 569 aa, Artificial Sequence
  derived and/or modified protein sequence (wt) from Lassa virus__AIT17845__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVTRTERPLSAGVYMGNLSSQQLDQRRALLNMIGMSGSNQGAQTGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDAPGERNPYENILYKICLSGDGWPYIASRTSITGRAWENTVVDLESDGKPQKAGSNGSNKSLQSAGFTAGLTYSQLMTLKDAMLQLDPNAKTWMDIEGRPEDPVEIALYQPSSGCYIHFFREPTDLKQFKQDAKYSHGIDVTDLFAAQPGLTSAVIDALPRNMVITCQGSDDIRKLFESQGRKDIKLIDIALSKTDSRKYENAVWDQYKDLCHMHTGIVVEKKKRGGKEEITPHCALMDCIMFDAAVSGGLNTSVLRAVLPRDMVFRTSTPRVVL

SEQ ID NO: 362 - protein, 569 aa, Artificial Sequence
  derived and/or modified protein sequence (wt) from Lassa virus__ANH09723__NP
MSASKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLTLAADLEKLKSKVTRTERPLTAGVYMGNLSSQQLDQRRALLNMIGMSGGNQGARTGRDGVVRVWDVKNAELLNNQFGTMPSLTLACLTKQGQVDLNDVVQALTDLGLIYTAKYPNTSDLDRLTQSHPILNMIDTNKSSLNISGYNFSLGAAVKAGACMLDGGNMLETIKVSPQTMDGILKSILKVKKSLGMFISDTPGERNPYENILYKICLSGDGWPYIASRTSITGRAWENTVVDLESGGKPQKAGSNNSNKSLQSAGFAAGLTYSQLMTLKDAMLQLDPNAKTWMDIEGRPEDPVEIALYQPISGCYIHFFREPTDLKQFKQDAKYSHGIDVTDLFAAQPGLTSAVIEALPRNMVITCQGSDDIRKLFESQGRKDIKLIDIALSKTDSRKYENAVWDQYKDLCHMHTGVVVEKKKKGGKEEITPHCALMDCIMFDAAVSGGLNTLVLRAVLPRDMVFRTSTPKVVL

SEQ ID NO: 363 - protein, 569 aa, Artificial Sequence
  derived and/or modified protein sequence (wt) from Lassa virus__ANH09725__NP
MSASKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLILAADLEKLKSKVTRTERPLSAGVYMGNLSSQQLDQRRALLNMIGMSGGNQGARAGRDGVVRVWDVKNADLLNNQFGTMPSLTLACLTKQGQVDLNDVVQALTDLGLIYTAKYPNTSDLDRLTQSHPILNMIDTNKSSLNISGYNFSLGAAVKAGACMLDGGNMLETIKVSPQTMDGILKSILKVKKSLGMFISDTPGERNPYENILYKICLSGDGWPYIASRTSITGRAWENTVVDLESGGKPQKAGSNNSNKSLQSAGFAAGLTYSQLMTLKDAMLQLDPNAKTWMDIEGRPEDPVEIALYQPISGCYIHFFREPTDLKQFKQDAKYSHGIDVTDLFAAQPGLTSAVIEALPRNMVITCQGSDDIRKLLESQGRKDIKLIDIALSKTDSRKYENAVWDQYKDLCHMHTGVVVEKKKRGGKEEITPHCALMDCIMFDAAVSGGLNTLVLRAVLPRDMVFRTSTPKVVL

SEQ ID NO: 364 - protein, 569 aa, Artificial Sequence
  derived and/or modified protein sequence (wt) from Lassa virus__ANH09729__NP
MSASKEIKSFLWTQSLRRELSGYCSNIKLQVVKDAQALLHGLDFSEVSNVQRLMRKQRRDDSDLKRLRDLNQAVNNLVELKSTQQKSVLRVGTLTSDDLLTLAADLEKLKSKVTRTERPLSAGVYMGNLSSQQLDQRRALLNMIGMSGGNQGARTGRDGVVRVWDVKNADLLNNQFGTMPSLTLACLTKQGQVDLNDVVQALTDLGLIYTAKYPNTSDLDRLTQSHPILNMIDTNKSSLNISGYNFSLGAAVKAGACMLDGGNMLETIKVSPQTMDGILKSILKVKKSLGMFISDTPGERNPYENILYKICLSGDGWPYIASRTSITGRAWENTVVDLESGGKPQRAGSNNSNKSLQSAGFAAGLTYSQLMTLKDAMLQLDPNAKTWMDIEGRPEDPVEIALYQPTSGCYIHFFREPTDLKQFKQDAKYSHGIDVTDLFAAQPGLTSAVIEALPRNMVITCQGSDDIRKLLESQGRKDIKLIDIALSKTDSRKYENAVWDQYKDLCHMHTGVVVEKKKKGGKEEITPHCALMDCIMFDAAVSGGLNTLVLRAVLPRDMVFRTSTPKVVL

SEQ ID NO: 365 - protein, 569 aa, Artificial Sequence
  derived and/or modified protein sequence (wt) from Lassa virus__ANH09731__NP
MSASKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLTLAADLEKLKSKVTRTERPLSAGVYMGNLSSQQLDQRRALLNMIGMTGGNQGARTGRDGVVRVWDVKNADLLNNQFGTMPSLTLACLTKQGQVDLNDVVQALTDLGLIYTAKYPNTSDLDRLTQSHPILNMIDTNKSSLNISGYNFSLGAAVKAGACMLDGGNMLETIKVSPQTMDGILKSILKVKKSLGMFISDTPGERNPYENILYKICLSGDGWPYIASRTSITGRAWENTVVDLESGGKPQRAGSNNSNKSLQSAGLAAGLTYSQLMTLKDAMLQLDPNAKTWMDIEGRPEDPVEIALYQPTSGCYIHFFREPTDLKQFKQDAKYSHGIDVTDLFAAQPGLTSAVIEALPRNMVITCQGSDDIRKLLESQGRKDIKLIDIALSKTDSRKYENAVWDQYKDLCHMHTGVVVEKKKKGGKEEITPHCALMDCIMFDAAVSGGLNTLVLRAVLPRDMVFRTSTPKVVL

SEQ ID NO: 366 - protein, 569 aa, Artificial Sequence
  derived and/or modified protein sequence (wt) from Lassa virus__ANH09733__NP
MSASKEIKSFLWTQSLRRELSGYCSNIKLQVVKDAQALLHGLDFSEVSNVQRLMRKQRRDDNDLKRLRDLNQAVNNLVELKSTQQKSVLRVGTLTSDDLLTLAADLEKLKSKVTRTERPLSAGVYMGNLSSQQLDQRRALLNMIGMSGGNQGARTGRDGVVRVWDVKNADLLNNQFGTMPSLTLACLTKQGQVDLNDVVQALTDLGLIYTAKYPNTSDLDRLTQSHPILNMIDTNKSSLNISGYNFSLGAAVKAGACMLDGGNMLETIKVSPQTMDGILKSILKVKKSLGMFISDTPGERNPYENILYKICLSGDGWPYIASRTSITGRAWENTVVDLESGGKPQRAGSNNSNKSLQSAGFAAGLTYSQLMTLKDAMLQLDPNAKTWMDIEGRPEDPVEIAFYQPISGCYIHFFREPTDLKQFKQDAKYSHGIDVTDLFAAQPGLTSAVIEALPRNMVITCQGSDDIRKLLESQGRKDIKLIDIALSKTDSRKYENAVWDQYKDLCHMHTGVVVEKKKKGGKEEITPHCALMDCIMFDAAVSGGLNTLVLRAVLPRDMVFRTSTPKVVL

SEQ ID NO: 367 - protein, 569 aa, Artificial Sequence
  derived and/or modified protein sequence (wt) from Lassa virus__ANH09735__NP
MSASKEVKSFLWTQSLRRELSGYCSNIKLQVVKDAQALLHGLDFSEVSNIQRLMRKERRDDSDLKRLRDLNQAVNNLVELKSTQQKSVLRVGTLSSDDLLTLAADLEKLKSKVIRTERPLSSGVYMGNLSTQQLDQRRALLNMIGMTNGGQGANAGRDGIVRVWDVKNAELLNNQFGTMPSLTLACLTKQGQVDLNDAVQALTDLGLIYTAKYPNSSDLDRLSQNHPILNMIDTKKSSLNISGYNFSLGAAVKAGACMLDGGNMLETIKVSPQTMDGILKSILKVKRSLGMFVSDTPGERNPYENILYKICLSGDGWPYVASRTSIIGRAWENTVVDLESDSKPQRPGSKESNRSLQTAGFPAGLTYSQLMTLKDSMLQLDPNAKTWMDIEGRPDDPVEIALYQPSSGCYIHFFREPTDLKQFKQDAKYSHGIDIGDLFAAQPGLTSAVIEALPRNMVITCQGSEDIKRLLESQGRKDIRLVDISLSKADSRKFENAVWDQFKDLCNMHTGVVVEKKKKGGKEEITPHCALMDCIMFDAAVMGGLDAKVLRAVLPKDMVFRTSTPRVVL

SEQ ID NO: 368 - protein, 569 aa, Artificial Sequence
  derived and/or modified protein sequence (wt) from Lassa virus__ANH09737__NP
MSASKEVKSFLWTQSLRRELSGYCSNIKLQVVKDAQALLHGLDFSEVSNIQRLMRKERRDDSDLKRLRDLNQAVNNLVELKSTQQKSVLRVGTLSSDDLLTLAADLEKLKSKVIRTERPLSSGVYMGNLSTQQLDQRRALLNMIGMTNGGQGANAGRDGIVRVWDVKNAELLNNQFGTMPSLTLACLTKQGQVDLNDAVQALTDLGLIYTAKYPNSSDLDRLSQNHPILNMIDTKKSSLNISGYNFSLGAAVKAGACMLDGGNMLETIKVSPQTMDGILKSILKVKRSLGMFVSDTPGERNPYENILYKICLSGDGWPYVASRTSIIGRAWENTVVDLESDSKPQRPGSKESNRSLQTAGFPAGLTYSQLMTLKDSMLQLDPNAKTWMDIEGRPDDPVEIALYQPSSGCYIHFFREPTDLKQFKQDAKYSHGIDMGDLFAAQPGLTSAVIEALPRNMVITCQGSEDIKRLLESQGRRDIRLVDISLSKADSRKFENAVWDQFKDLCNMHTGVVVEKKKKGGKEEITPHCALMDCIMFDAAVMGGLDAKVLRAVLPKDMVFRTSTPRVVL

SEQ ID NO: 369 - protein, 569 aa, Artificial Sequence
  derived and/or modified protein sequence (wt) from Lassa virus__ANH09739__NP
MSASKEVKSFLWTQSLRRELSGYCSNIKLQVVKDAQALLHGLDFSEVSNIQRLMRKERRDDSDLKRLRDLNQAVNNLVELKSTQQKSVLRVGTLSSDDLLTLAADLEKLKSKVIRTERPLSSGVYMGNLSTQQLDQRRALLNMIGMTSGGQGANAGRDGIVRVWDVKNAELLNNQFGTMPSLTLACLTKQGQVDLNDAVQALTDLGLIYTAKYPNSSDLDRLSQNHPILNMIDTKKSSLNISGYNFSLGAAVKAGACMLDGGNMLETIKVSPQTMDGILKSILKVKRSLGMFVSDTPGERNPYENILYKICLSGDGWPYVASRTSIIGRAWENTVVDLESDSKPQRPGSKESNRSLQTAGFPAGLTYSQLMTLKDSMLQLDPNAKTWMDIEGRPDDPVEIALYQPSSGCYIHFFREPTDLKQFKQDAKYSHGIDIGDLFAAQPGLTSAVIEALPRNMVITCQGSEDIKRLLESQGRRDIRLVDISLSKADSRKFENAVWDQFKDLCNMHTGVVVEKKKKGGKEEITPHCALMDCIMFDAAVMGGLDAKVLRAVLPKDMVFRTSTPRVVL

SEQ ID NO: 370 - protein, 569 aa, Artificial Sequence
  derived and/or modified protein sequence (wt) from Lassa virus__ANH09741__NP
MSNSKEVKSFLWTQSLRRELSGYCTNIKLQVVKDAQALLHGLDFSEVSNVQRLMRKQKRDDNDLKRLRDLNQAVNNLVELKSVQQKSVLKVGTLNSDDLLTLAADLEKLKSKVVRTERPLSSGVYMGNLSSQQLDQRRALLNMIGMAGGSQGNQPSRDGVVRVWDVKNADLLNNQFGTMPSLTLACLTKQGQVDLNDVVLALTDLGLIYTAKYPNSSDLDRLSQNHPVLNMIDVNKSSLNISGYNFSLGAAVKAGACMLDGGNMLETIKISPQTVDGILKSILKVKRALGMFVSDTPGERNPYENILYKVCLSGNGWPYIASRTSIVGRAWENTVVDLESNKNQPKVGNNGSNKMLQSSGFATGLTYSQLMTLRDSMLQLDPTAKTWIDIEGRPEDPVELALFQPSSGCYIHFFREPTDLKQFKQDAKYSHGIDVNDLFSAQPGLTSAVLEALPRNMVLTCQGSDDIRKLLDSQDRKDIKLIDISLSKADARKFENDVWDQFKDLCHMHTGIVVEKKKKGGKQEMTPHCALLDCIMFDAAVSGGLNVPTLRAVLPTDMVFRTITTKVVL

SEQ ID NO: 371 - protein, 570 aa, Artificial Sequence
  derived and/or modified protein sequence (wt) from Lassa virus__CAA36646__NP
MSASKEVRSFLWTQSLRRELSGYCSNIKLQVVKDAQALLHGLDFSEVSNVQRLMRKQKRDDGDLKRLRDLNQAVNNLVELKSTQQKSVLRVGTLSSDDLLILAADLEKLKSKVTRTERPLSSGVYMGNLSSQQLDQRRALLNMIGMTGVSGGGKGASDGIVRVWDVKNAELLNNQFGTMPSLTLACLTKQGQVDLNDAVQALTDLGLIYTAKYPNSSDLDRLSQSHPILNMIDTKKSSLNISGYNFSLGAAVKAGACMLDGGNMLETIKVSPQTMDGILKSILKVKKSLGMFVSDTPGERNPYENILYKICLSGDGWPYIASRTSIVGRAWENTVVDLEQDNKPQKIGNGGSNKSLQSAGFAAGLTYSQLMTLKDFKCFNLIPNAKTWMDIEGRPEDPVEIALYQPSSGCYVHFFREPTDLKQFKQDAKYSHGIDVTDLFAAQPGLTSAVIEALPRNMVITCQGSEDIRKLLESQGRRDIKLIDITLSKADSRKFENAVWDQFKDLCHMHTGVVVEKKKRGGKEEITPHCALMDCIMFDAAVSGGLDAKVLRVVLPRDMVFRTSTPKVVL

SEQ ID NO: 372 - protein, 569 aa, Artificial Sequence
  derived and/or modified protein sequence (wt) from Lassa virus__CCA30315__NP
MSASKEVKSFLWTQSLRRELSGYCSNIKLQVVKDAQALLHGLDFSEVSNVQRLMRKQRRDDSDLKRLRDLNQAVNNLVELKSTQQKSVLRVGTLSSDDLLTLAADLEKLKSKVTRTERPLSSGVYMGNLSSQQLDQRRALLNLIGMTNGSQGSQAGRDGVVRVWDVKNAELLNNQFGTMPSLTLACLTKQGQVDLNDVVQALTDLGLIYTAKYPNTSDLDRLTQSHPILNMIDTKKSSLNISGYNFSLGAAVKAGACMLDGGNMLETIKVSPQSMDGILKSILKVKRALGMFVSDTPGERNPYENILYKICLSGDGWPYIASRTSIVGRAWENTVVDLETDGKPQKIGSGNSNKSLQSAGFSAGLTYSQLMTLKDAMLQLDPNAKTWMDIEGRPEDPVEVALYQPISGCYIHFFREPTDLKQFKQDAKYSHGIDIADLFAAQPGLTSAVIEALPRNMVITCQGSEDIKKLLESQGRKDIKLIDIALSKIDSRKFENAVWDQYKDLCHMHTGVVVEKKKRGGKEEITPHCALMDCIMFDAAVSGGLNTLVLRAVLPRDMVFRTSTPRVVL

SEQ ID NO: 373 - protein, 569 aa, Artificial Sequence
  derived and/or modified protein sequence (wt) from Lassa virus__JX985061__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLRSKVIRTERPLSAGVYMGNLSSQQLDQRRALLNMIGMSGGNQGARAGRDGVVRVWDVKNAELLSNQFGTIPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNNSSKSLQSAGFTAGLTYSQLMTLKDAMLQLDPNAKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIDLSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 374 - protein, 569 aa, Artificial Sequence
  derived and/or modified protein sequence (wt) from Lassa virus__NP_694869__NP
MSASKEIKSFLWTQSLRRELSGYCSNIKLQVVKDAQALLHGLDFSEVSNVQRLMRKERRDDNDLKRLRDLNQAVNNLVELKSTQQKSILRVGTLTSDDLLILAADLEKLKSKVIRTERPLSAGVYMGNLSSQQLDQRRALLNMIGMSGGNQGARAGRDGVVRVWDVKNAELLNNQFGTMPSLTLACLTKQGQVDLNDAVQALTDLGLIYTAKYPNTSDLDRLTQSHPILNMIDTKKSSLNISGYNFSLGAAVKAGACMLDGGNMLETIKVSPQTMDGILKSILKVKKALGMFISDTPGERNPYENILYKICLSGDGWPYIASRTSITGRAWENTVVDLESDGKPQKADSNNSSKSLQSAGFTAGLTYSQLMTLKDAMLQLDPNAKTWMDIEGRPEDPVEIALYQPSSGCYIHFFREPTDLKQFKQDAKYSHGIDVTDLFATQPGLTSAVIDALPRNMVITCQGSDDIRKLLESQGRKDIKLIDIALSKTDSRKYENAVWDQYKDLCHMHTGVVVEKKKRGGKEEITPHCALMDCIMFDAAVSGGLNTSVLRAVLPRDMVFRTSTPRVVL

SEQ ID NO: 375 - protein, 569 aa, Artificial Sequence
  derived and/or modified protein sequence (wt) from Lassa virus__SCA79106__NP
MSNSKEVKSFLWTQSLRRELSGYCSNIKLQVVKDAQALLHGLDFSEVSNVQRLMRKQKRDDGDLKRLRDLNQAVNNLVELKSVQQKSILRVGTLTSDDLLTLAADLEKLKSKVTRTERPLSSGVYMGNLSSQQLDQRRALLSMIGMSGGNQNSQPKGDGVVRVWDVKNADLLNNQFGTMPSLTLACLTKQGQVDLNDAVQALTDLGLIYTAKYPNSSDLDRLSQSHPILNMIDTKKSSLNISGYNFSLGAAIKTGACMLDGGNMLETIKVTPQTMDGILKSILKVKRSLGMFISDTPGERNPYENILYKICLSGDGWPYIASRTAIIGRAWENTVVDLESDSKPQKIGSNGSNKSLQSAGFAPGLTYSQLMTLKDSMLQLDPNAKTWIDIEGRPEDPVEVALFQPISGCYIHFFREPTDLKQFKQDAKYSHGIDVTDLFAAQPGLTSAVIEALPRNMVLTCQGSDDIKKLLDSQGRRDIKLIDVSLNKIDSRKFENAVWDQYKDLCHMHTGVVVEKKKKGGKEEITPHCALLDCIMFDAAVSGGLNATVLRAVLPRDMVFRTSSPKVVL

SEQ ID NO: 376 - RNA, 1473 nt, Artificial Sequence
  derived and/or modified CDS sequence (wt) from Lassa virus__AAF86703__GPC
auggggcaaaucauaacauucuuccaagaggugccucaugucauagaggaggucaugaacauuguccuaauugcccucagucuccuggcgauacuaaaggggauuuacaauguugcuaccuguggucucuuuggguugaucuccuuucuucucuuauguggcagaucauguucaguaaccuauaaagguguuuaugagcuacaaacucuagaacugaacauggcaaaccuuaauaugacgaugcccuugucuuguacgaagaacaacagccaucauuacaucaugguuggaaaugaaacaggccuagagcugaccuuaacaaacacaagcaucauuaaccacaaguuuugcaaccuuucugaugcacauaaaaagaaucucuaugaccaugcucugaugagcaucaucucaacuuuccacuuaucuauuccaaacuuuaaucaguaugaagcaaugaguugugacuucaauggagggaaaauaaguguucaguacaaccucagucacuccuuugcuguggaugcagccaaccacugugggaccauugccaaugguguucugcagaccuuuaugaggauggcuugggguggcaguuacauagcacuugauuccggaaaagggaacugggauuguauaaugacuuccuaucaauacuugauaauucaaaacaccacuugggaagaucacugccaguuuucucgcccaucuccuauugguuacuuaggacuauugucacagagaacuagagauaucuauaucagucgaagacuucucggaacuuucacuuggacccuuucugauucugaagguaaugaagcaccugguggguauugucuaacuagauggauguuaauugaagcagaacugaaaugcuuugggaacacagcaguugcaaagugcaacgaaaaacaugaugaagaauuuugugacauguugagauuguuugauuucaacaaacaagcuauaaagaggcugaaaacagaagcacagaugaguauucagcugauaaacaaggcagugaaugcauuaaucaaugaccaacugauuaugaagaaccaucuaagggacaucaugggaauuccuuauugcaacuacaguagauauugguaucuaaaucacacugugacagggaagacaucacugccaagauguuggcuugugucaaaugguuccuaccuaaacgaaacacauuuuucugaugacauugaacaacaagcagacaacaugauaacagaaauguugcagaaagaguacauggacaggcaggggaaaacaccuuuaggguuaguggaccuuuuugucuuuagcacuagcuuuuaccucauaagcaucuuucuccaucuggucaagaucccaacucacaggcacaucguggggaaaccuugcccuaagccacacagacucaaccacaugggcaucugcucauguggucuguauaaacaucccgguguuccaguaaaauggaagagauaa

SEQ ID NO: 377 - RNA, 1476 nt, Artificial Sequence
  derived and/or modified CDS sequence (wt) from Lassa virus__AAG41802__GPC
auggggcaaauagugacauucuuucaagaggugccucaugugauagaagaggugaugaacauuguucuuauagcauugucuauauuggcaguguugaaaggucucuacaacauugccacaugcggccucaucggcuugaucacuuuccucuuauuauguggaaggucuugcucauccaaccucuacaagggggucuaugaacuucaaucucuggaccugaacauggagacacucaacaugaccaugccccucuccugcacaaagaacaauagucaucacuacauaaggguuggcaaugacacagggcuggaacugaccuugaccaacacgagcauacucaaucacaaauucugcaaccuaucagaugcucacaagaaagaccuauaugaucacgcacucaugagcauaaucucaacuuuccaccugucuauacccaauuucaaccaauacgaagcaaugaguugugacuucaaugggggcaaaaucagugugcaguacaaucuaagccauucuuaugcuauagaugcagcuaaucauugcggcacagucgcgaauggcaucuugcagacuuucaugagaauggcauggggugggagcuauauugcucuugacucaggccguggaaacugggacuguauuaugacuagcuaucaauaucugauuauucagaacacaaccugggaaaaucacugucaguucucaagaccaucuccuauugguuaucuuggucuccucucacagaggacuagagacauuuacauuagcaggagguugcugggcacauucacguggacacugucagacucugaggguaaugcuacaccaggagguuauugucugaccagguggauguuaauugaagcugaguugaaaugcuuuggaaacacagcaguagcaaaguguaaugaaaagcaugaugaagaauuuugcgacaugcucagacuuuuugauuuuaauaagcaggcuauaaguagauugaaaucugaagcacaaaugagcauccaacugaucaacaaagcagugaaugcuuugaucaacgaucaauuaauuaugaagaaccacuugcgagacaucauggggauuccauauuguaauuacagcaaguauugguaccucaaucauacaauaacuggcaaaaccucauuaccuaaauguuggcuuguaucuaaugguucauacuugaaugaaacccauuuuucugacgacaucgagcaacaagcugacaauaugaucacagagaugcuacaaaaggaauacauggagaggcaagggaaaacgccuuuggguuuaguugaucuguuuguguuuagcacaaguuuuuaucuaauuaguaucuuccuccgacuagucaagauuccaacccauagacacauugugggcaaaccauguccuaagccccacagguugaaccacaugggcauuuguucuugcggcuuauacaagcagccuggcguccccgugagauggaagagauag

SEQ ID NO: 378 - RNA, 1473 nt, Artificial Sequence
  derived and/or modified CDS sequence (wt) from Lassa virus__AAL13212__GPC
augggucagauagugacauucuuucaggaaguuccucaugucauugaggaaauuaugaacauuguccucaucaccuuaucucugcuugcaaucuugaaggguguguacaauuuggccacguguggccuuauuggucugauaacauuccuuuuccucuguggaaggucauguucgaugaccuacaaagggaguuaucaacuugaaacccuugagcugaacauggagacgcuuaacaugacuaugccucuguccugcacaaaaaauacuagucaccacuacauaaggguggguaaugaaacagggcuugagcugaccuuaaccaauacaagcaucauaaaccacaaguucugcaaucucucugaugcacacaaaaagaaucucuacgaccacucucucaugagcauuaucucuaccuuucaucuguccaucccuaacuuuaaucaguaugaagccaugaguugugacuucaauggagguaagauuagcauccaauacaauuugagccacaccuaugcaggagaugcagccaaacauuguggcacuuuggcaaaugguauacugcaaaccuucaugaggauggcuuggggugggaguuacauugcacuugacucaggucgaggaaacugggauuguauaaugacuagcuaccaauacuuaaucauucagaauacaaccugggaggaccauugucaauuuucaagaccaucacccauuggcuaucuugggcuccucucucaaaggaccagagaaauuuacaucaguagaagacugcuaggaacauuuacauggacauugucagauucugaaggcaaugaaaauccaggggguuacugcuuaaccagauggauguuaauugaagcugaacugaaauguuuugggaauacugcaguagcuaaaugcaaugagaaacaugaugaggaauuuugugacaugcugaggcuuuuugauuucaacaaacaagccauucagagauugaaggcugaggcucaaaugaguauucagcuuauuaacaaagcagucaaugcccucauaaaugaccagcuuauaaugaaaaaucaucucagagacauuaugggcauaccauauugcaacuauagcaaauauugguaucuuaaucauacgaccacggguagaacuucacuaccaagaugcuggcuuguaucaaacggguccuaucucaaugaaacucguuucucagacgacauagaacaacaagcugacaacaugauaacagaaauguugcagaaagaguacaucgauagacaaggaaagaccccacuaggcuugguugacuuguuuguguucagcacaagcuucuauuugaucaguauuuuucuacacuuaaucaagauaccaacucauagacacauuguaggugggccaugccccaaaccucacaggcuaaaccacaagggcauuugcucuugugggcuauauaaacggccaggagugucugugagguggaagagauaa

SEQ ID NO: 379 - RNA, 1476 nt, Artificial Sequence
  derived and/or modified CDS sequence (wt) from Lassa virus__AAO59512__GPC
augggacaaauagucacauucuuccaggaagugccucauguaauagaagaggugaugaacauuguccucauugcgcugucuauacuagcugugcugaagggucuguacaacuuugcgacauguggccucguugguuuaguugcuuuccucuuguuguguggcaggucuugcacaagcagucuuuacaaagggguuuaugagcuccagacucuggaacuaaacauggagacacucaauaugaccaugccucucucuugcacaaagaacaacagucaucauuacauaagggugggcaaugagacaggacuagaacugaccuugaccaacaccaguauuauuaaucauaaauuuugcaaucuaucugaugcucacaagaagaaccuuuaugaccacgcucuuaugagcauaaucucaacuuuccacuuguccaucccaaacuucaaucaguaugaggcaaugagcugugauuucaacggaggaaagauuagugugcaguacaaccugagccacagcuaugcuguggaugcagccaaacauuguggcacaguugcaaauggugucuuacagacuuucaugaggauggcuugggguggaagcuacauugcucuugauucaggccaugguagaugggacuguauuaugacuaguuaucaauaucuaauaauucagaauacaaccugggaagaucacugccaauucucaagaccaucucccauugguuaucucgggcuccucucacagaggacuagagacauuuauauuaguagaagacuacuaggcacauuuacauggacacugucagacucugaaggcaaggacacaccagggggauauugucugaccagauggaugcuaauugaagcugagcuaaaaugcuucgggaacacagcuguggcaaaauguaaugagaaacaugaugaggaauuuugugacaugcugaggcuguuugacuucaauaaacaagccauucaaaggcugaaaacugaagcacaaaugagcauucaguugaucaauaaagcagugaaugcuuugauaaaugaccaacuaauaaugaagaaucauuugcgggacauaaugggaauuccauacuguaauuacagcagguauugguaccuuaaccacacaacuacuggaaaaacaucacugcccaaauguuggcuuguaucaaaugguucauaccugaacgagacccgcuuuucugacgauauugaacaacaagcugacaacaugaucacugagauguuacagaaagaguacauggaaaggcaggggaagacaccauugggucuaguugaccucuuuguguucagcacaaguuucuaucucauuagcaucuuccuucaccuaguuaaaauaccgacucauaggcauauugugggcaagucaugucccaagccucacagguugaaucacaugggcauauguuccugcggacucuauaaacagcccggugugccuguaaaauggaagagguga

SEQ ID NO: 380 - RNA, 1476 nt, Artificial Sequence
  derived and/or modified CDS sequence (wt) from Lassa virus__AAT49000__GPC
auggggcaaauagucacauuuuuccaggaagucccucauguaauagaggaggucaugaacauuguacuuauugcacuguccauacuagcugugcugaaagguuuguacaauguugcaacauguggccuuauuggcuuggucaccuuucucuuccuaugugguaggucuuguucaaccucucuuuacaagggaguuuaugagcuucagaccuuggaguugaacauggaaacacugaauaugacaaugccccucucuugcacaaagaacaacagucaccauuacauaaugguggguaaugagacaggacuagaacugacuuugaccaacacaaguauuauaaaucacaaguucugcaaucuaucugaugcccacaaaaagaaucucuaugaccacacucuuaugagcauaaucucaacuuuccaucugucuauacccaauuucaaucaguaugaagcaaugaguugugacuuuaauggggguaagaucagugugcaauacaaccugagucacaguuaugcuguagaugcagcuaaucauugugguacaguggcaaaugguguuuugcagaccuucaugaggauggcuuggggcggaaguuacauugcccuugauucaggucguggcaacugggacugcaucaugacuaguuaccaauaucuuguaauucagaacacaaccugggaagaccauugucaguucucaagaccaucucccaucggcuaucuugggcuccuuucacagagaaccagagauauuuacaucagcaggagauugcugggaacauucacauggacacuaucagauucugaagguaaggacacaccagggggguacuguuugaccagguggaugcugauugaagcugaguuaaagugcuuuggcaacacagccguggcaaaguguaaugagaaacaugaugaagaguuuugugacaugcugaggcuauuugacuucaacaaacaagccauccaaagauugaaagccgaggcucagaugaguauacagcugaucaacaaagcaguaaaugcucugauaaaugaucagcuaauaaugaagaaccauuugcgagacauuauggggaucccauacugcaauuacagcaaauacugguaucucaaccacacagucacuggaaagacaucauugcccaaauguuggcuuguaucaaauggaucauaccuaaaugagacccacuucucugaugauaucgaacagcaagcugacaauuuaaucacugagauguuacaaaaggaauacauggaaagacaaggcaaaacaccauuagguuugguugaccucuuuguguucaguacaagcuuuuaccuuauaagcaucuuccuccaccuagucaaaauaccaacacauagacacauuguaggcaaaccauguccuaaaccucauaggcugaaccauauggguauauguuccugugguguuuacaaacaaccugguguaccugugagauggaaaagguaa

SEQ ID NO: 381 - RNA, 1476 nt, Artificial Sequence
  derived and/or modified CDS sequence (wt) from Lassa virus__AAT49004__GPC
augggacaaauagugacauucuuccaggaagugccucauguaauagaagaggugaugaacauuguucucauugcacugucuguacuagcagugcugaaaggucuguacaauuuugcaacguguggccuuguugguuuggucacuuuccuccuguugugugguaggucuugcacaaccagucuuuauaaagggguuuaugagcuucagacucuggaacuaaacauggagacacucaauaugaccaugccucucuccugcacaaagaacaacagucaucauuauauaauggugggcaaugagacaggacuagaacugaccuugaccaacacgagcauuauuaaucacaaauuuugcaaucugucugaugcccacaaaaagaaccucuaugaccacgcucuuaugagcauaaucucaacuuuccacuuguccauccccaacuucaaucaguaugaggcaaugagcugcgauuuuaaugggggaaagauuagugugcaguacaaccugagucacagcuaugcuggggaugcagccaaccauugugguacuguugcaaaugguguguuacagacuuuuaugaggauggcuuggggugggagcuacauugcucuugacucaggccguggcaacugggacuguauuaugacuaguuaucaauaucugauaauccaaaauacaaccugggaagaucacugccaauucucgagaccaucucccaucgguuaucucgggcuccucucacaaaggacuagagauauuuauauuaguagaagauugcuaggcacauucacauggacacugucagauucugaagguaaagacacaccagggggauauugucugaccagguggaugcuaauugaggcugaacuaaaaugcuucgggaacacagcuguggcaaaauguaaugagaagcaugaugaggaauuuugugacaugcugaggcuguuugacuucaacaaacaagccauucaaagguugaaagcugaagcacaaaugagcauucaguugaucaacaaagcaguaaaugcuuugauaaaugaccaacuuauaaugaagaaccaucuacgggacaucaugggaauuccauacuguaauuacagcaaguauugguaccucaaccacacaacuacugggagaacaucacugcccaaauguuggcuuguaucaaaugguucauacuugaacgagacccacuuuucugaugauauugaacaacaagcugacaauaugaucacugagauguuacagaaggaguauauggagaggcaggggaagacaccauugggucuaguugaccucuuuguguucagcacaaguuucuaucuuauuagcaucuuccuucaccuagucaaaauaccaacucauaggcauauuguaggcaagucgugucccaaaccucacagauugaaucauaugggcauuuguuccuguggacucuacaaacagccuggugugccugugaaauggaagagauga

SEQ ID NO: 382 - RNA, 1476 nt, Artificial Sequence
  derived and/or modified CDS sequence (wt) from Lassa virus__AAT49008__GPC
auggggcaaauagucacauuuuuccaggaagucccucauguaauagaggaggucaugaacauuguacuuaucgcacuguccauacuagcugugcugaaagguuuguacaauguugcaacauguggccuuauuggcuuggucaccuuucucuuccuaugugguaggucuuguucaaccacucuuuacaagggaguuuaugagcuucagaccuuggaguugaacauggaaacacugaacaugacaaugccccucucuugcacaaagaacaacagucaccauuacauaauggugggcaaugagacaggacuggaacugacuuugaccaacacaaguauuauaaaucacaaguucugcaaucuaucugaugcccacaaaaagaaucucuaugaccacacucuuaugagcauaaucucaacuuuccaucugucuauaccuaauuucaaucaguaugaagcaaugaguugugacuuuaauggggguaagaucagugugcaauacaaccugagucacaguuaugcuguagaugcagcuaaucauuguggcacaguggcaaaugguguuuugcagaccuucaugaggauggcuuggggcgggaguuacauugcccuugauucaggucguggcaacugggacugcaucaugacuaguuaccaauaucuuauaauucagaacacaaccugggaagaccauugucaguucucaaggccaucucccaucggcuaucuugggcuccuuucacaaagaaccagagauauuuacaucagcaggagauugcugggaacauucacauggacacuaucagauucugaagguaaagacacaccaggaggguacuguuugaccagguggaugcugauugaagcugaguuaaagugcuuuggcaacacagccguggcaaaguguaaugagaagcaugaugaagaguuuugugacaugcugaggcuauuugacuucaacaaacaagccauccaaagauugaaagccgaggcucagaugaguauacaacugaucaacaaagcaguaaaugcucugauaaaugaucagcuaauaaugaagaaccauuugcgagacauuauggggaucccauacugcaauuacaguagauacugguaucucaaccacacagucaccggaaagacaucauugcccaaguguuggcuugugucaaauggaucauaccuaaaugagacccacuucucugaugauaucgaacagcaagcugacaauuugaucacugagauguuacaaaaggaauacauggaaagacaaggcaaaacaccauuggguuugguugaccucuuuguguucaguacaagcuuuuaccuuauaagcaucuuccuccaccuagucaaaauaccaacucauagacacauuguaggcaaaccauguccuaaaccucauagauugaaccauauggguauaugcuccugugguguuuacaaacaaccugguguaccugugagauggaaaagguaa

SEQ ID NO: 383 - RNA, 1473 nt, Artificial Sequence
  derived and/or modified CDS sequence (wt) from Lassa virus__AAT49010__GPC
augggacagauugugacauucuuccaagaagucccucaugucauugaggagguaaugaacaucguccucauagcauuguccguuuuggcaauuuuaaaggggcucuacaacuuugccacaugcggcuugauaggccuuguaacauuccuccuacuuucugggaggucaugcucaaugaucuacaaaggaguuuaugaacuacagacccuugaauugaacauggagacauugaacaugacuaugccauuguccugcacaaagaacaccagucaucauuacauccgugugggaaaugauacaggacuugaacucacccugaccaacgaaacuuuacuccaccauaaguucugcaaccucucagaugcucauaagagaaaucuuuaugaucaugcccucaugagcaucauuucuacuuuccaucuauccauccccaacuuuaaccaauaugaagcaaugaguugugacuuuaauggugggaagaucacagugcaauacaaccuaagucacaguuaugcaguugaugcagcaaaacacugcggcacaguagcaaaugguguguugcagacauuuaugagaauggcuuggggaggcagcuauauugcccuugauucuagacaugggaacugggacuguauaaugaccaguuaucaauacuuaauuauccagaauacaacuugggaagaccacugccaguucuccagaccaucuccuauugguuaucucgggcuccucucacaaagaaccagggacauuuacauuaguaggagauuauuaggaacguuuacuuggacacucucugacucugaaggaaaugagacgccaggaggauacugucucaccagguggauguuaauugaggcugagcugaaguguuuuggaaacacagcaguugccaagugcaaugaaaaacaugaugaagaguuuugugacaugcuaagacuauuugacuuuaacaaacaagccauuaggagguuaaagacagaagcccaaaugaguauacaauugaucaacaaagcagucaaugccuuaauaaaugaucaguugauuaugaagaaucaucugagagauauuauggguauaccauacugcaauuacaguaaauauugguaccucaaucacacaucaacagggaagacuucauugccuagauguuggcuuguuucaaacgggucauaccuuaaugaaacucacuucucugaugauauugaacaacaagcugauaacaugauaacugagaugcugcaaaaggaauaccuagauagacaagggaagaccccuuuaggguuaguugaucuuuuugucuuuagcacaaguuuuuauuugaucaguaucuuccuccaucugaucaaaauaccaacccauaggcacauuguggggaaaccuugccccaaaccccacaggcugaaucacaugggcaucugcucuugugguuuauacaaacagccaggggugcccgucagauggaagagauaa

SEQ ID NO: 384 - RNA, 1473 nt, Artificial Sequence
  derived and/or modified CDS sequence (wt) from Lassa virus__AAT49014__GPC
auggggcagauuauuacauucuuucaagaagugccacauguaauagaggaagucaugaacauugugcuaauugcgcuuucucuauuggcaaucuugaagggcuuguauaacaucgcuacaugugggauuauuggauugguugccuuuuuauucuuguguggcaagucuuguucccuaacccuuaaagggggauaugagcugcaaaccuuagaauuaaauauggagacccuaaacaugaccaugcccuuaucaugcaccaagaacagcagucaucauuacauaagagugggcaaugagacuggauuagaauugacuuuaacuaacaccagcauuauaaaucacaaauuuugcaacuuauccgaugcucacaaaaagaaucuuuaugaucaugcucucaugagcaucaucucaacauuccaucuauccauuccaaacuucaaucaguaugaagccaugaguugugauuucaauggagggaaaaucagugugcaauacaaccucucucauuccuaugcuggggaugcggccgaacacugugggacaguugccaacggaguguugcaaacauuuaugagaauggccugggguggaagauacauugcauuagacucaggaaagggaaacugggacuguauaaugaccagcuaccaguaccugauaauucaaaauacaacaugggaggaccacugccaauucucaagaccgucuccuaucggguaccuuggccuuuugucacaaaggacaagagauauauauauaaguaggaggcucuuggggaccuucaccuggacauugucagauucugagggcaaugaaacaccaggugguuauuguuuaaccagguggaugcuaauugaagcagaacucaaguguuuugggaauacagcuguggcaaaaugcaaugagaagcaugaugaggaguuuugugacaugcugagauuguuugauuucaacaagcaagcaauccguagguugaaggcugaggcccagaugaguauucaauuaauaaauaaagccgugaaugccuuaaucaaugaucaauuaaucaugaagaaccauuuaagagacaucaugggcauucccuacugcaauuacagcaaguauugguaccuuaaucauacuaguagcgggagaacaucacuaccaaaguguuggcuuauauccaaugggucauaucuaaaugaaacccaguucucugaugacauagaacagcaagccgaccauaugaucacagagaugcuucagaaagaauacauugaaagacaagggaaaacgcccuugggacuaguggacauuuucaucuuuagcacaagcuuuuaucugaucagcauuuucuugcauuuaauuaaaaucccuacacaucgacacaucguugggaaacccugucccaaaccccauagacuaaaucacaugggaguauguuccuguggacuguacaaacacccugguguuccaacaaaguggaagagauag

SEQ ID NO: 385 - RNA, 1476 nt, Artificial Sequence
  derived and/or modified CDS sequence (wt) from Lassa virus__AAV54104__GPC
augggacaaauagugacauucuuccaggaagugccucauguaauagaagaggugaugaacauuguucucauugcacugucuguacuagcagugcugaaaggucuguacaauuuugcaacguguggccuuguugguuuggucacuuuccuccuguugugugguaggucuugcacaaccagucuuuauaaagggguuuaugagcuucagacucuggaacuaaacauggagacacucaauaugaccaugccucucuccugcacaaagaacaacagucaucauuauauaauggugggcaaugagacaggacuagaacugaccuugaccaacacgagcauuauuaaucacaaauuuugcaaucugucugaugcccacaaaaagaaccucuaugaccacgcucuuaugagcauaaucucaacuuuccacuuguccauccccaacuucaaucaguaugaggcaaugagcugcgauuuuaaugggggaaagauuagugugcaguacaaccugagucacagcuaugcuggggaugcagccaaccauugugguacuguugcaaaugguguguuacagacuuuuaugaggauggcuuggggugggagcuacauugcucuugacucaggccguggcaacugggacuguauuaugacuaguuaucaauaucugauaauccaaaauacaaccugggaagaucacugccaauucucgagaccaucucccaucgguuaucucgggcuccucucacaaaggacuagagauauuuauauuaguagaagauugcuaggcacauucacauggacacugucagauucugaaggugaagacacaccagggggauauugucugaccagguggaugcuaauugaggcugaacuaaaaugcuucgggaacacagcuguggcaaaauguaaugagaagcaugaugaggaauuuugugacaugcugaggcuguuugacuucaacaaacaagccauucaaagguugaaagcugaagcacaaaugagcauucaguugaucaacaaagcaguaaaugcuuugauaaaugaccaacuuauaaugaagaaccaucuacgggacaucaugggaauuccauacuguaauuacagcaaguauugguaccucaaccacacaacuacugggagaacaucacugcccaaauguuggcuuguaucaaaugguucauacuugaacgagacccacuuuucugaugauauugaacaacaagcugacaauaugaucacugagauguuacagaaggaguauauggagaggcaggggaagacaccauugggucuaguugaccucuuuguguucagcacaaguuucuaucuuauuagcaucuuccuucaccuagucaaaauaccaacucauaggcauauuguaggcaagucgugucccaaaccucacagauugaaucauaugggcauuuguuccuguggacucuacaaacagccuggugugccugugaaauggaagagauga

SEQ ID NO: 386 - RNA, 1476 nt, Artificial Sequence
  derived and/or modified CDS sequence (wt) from Lassa virus__ADI39451__GPC
augggacagauugugacauucuuccaagaggugccucaugugauagaggaggugaugaacauugugcucauugcauugucugugcuugcaguacugaaaggccuguacaauguagcaacauguggccucauuggccucauugccuuucuucuacuuuguggcagauccuguacaacaacccuuuauaaggggguguaugaacuucaagcucuggaauugaacauggaaacacucaacaugaccaugccucucuccugcacaaaaaacaacagucaccauuauauaauggugggcaaugagacaggauuggaauugacuuugaccaacacaagcauuaucaaccacaaguucuguaaccucucugaugcucacaaaaagaaucuuuacgaucacgcucucaugagcauaaucucaacuuuccacuuguccauucccaacuucaaucaguaugaggcaaugaguugugacuucaaugggggaaagaucagugugcaguacaaucugagucacacuuaugcuguggacgcagccaaucauuguggcacagucgcuaaugguguuuugcagaccuuuaugaggauggccuggggugggagcuauauugcucuugacucaggccgugguaguugggacugcauuaugaccaguuaucaguauuugauaauucaaaacacaaccugggaagaccacugucaauucucaagaccaucccccauugguuaucuugggcuccuaucacagagaacaagagauaucuacauuaguaggagacuguuaggcacauucaccuggacauugucagauucugaaggcaaagauacaccaggaggauacugcuugaccagguggauguugauugaggcugaguugaaaugcuuugguaacacagcuguggcaaaaugcaaugaaaaacacgaugaagaauucugugacaugcuuagguuguuugauuucaacaagcaagccauucaaagauugaaagcugaggcacaaaugagcauacaauuaauuaacaaagcagugaaugcucuaauaaaugaccagcuaauuaugaagaaucauuugcgugacaucaugggaauaccauacuguaauuauaguaaguauugguaucucaaucacacaaucacugggaggacuucccuaccaaaaugcuggcuuguguccaaugguucauaccugaaugaaacucacuucucugaugauauagagcagcaagcugacaauaugaucacugaaaugcugcaaaaggaauauauagagagacaggggaagacaccauuaggucuaguugaccucuuuguguuuagcacgaguuuuuaucucauaaguauuuuccuacacuuaaucaagauaccaacucauagacacauugugaacaaaccguguccuaaaccccacaggcugaaucacauggguguguguucaugcggucucuacaagcagccuggcguuccugugagauggaagagauga

SEQ ID NO: 387 - RNA, 1473 nt, Artificial Sequence
  derived and/or modified CDS sequence (wt) from Lassa virus__ADU56610__GPC
augggacaaauaguaacauucuuucaggaaguuccucaugucauagaagagguaaugaauauuguccuaauugcucuuagucuccuggcgauacugaaggggauuuacaauguugccacuuguggccuuuuugggcugaucuccuuucuucuucuguguggaagaucaugcucaacaaccuacaaaggugucuaugagcuacaaacucuggaguuggacauggcaaaccucaacaugacuaugccucuaucuuguacaaaaaacagcagccaucacuauaucaugguugggaaugaaacaggccuagaacugaccuugacaaacacaaguauaaucaaucacaaguucugcaaccuuucugaugcacacaagaagaaucuuuaugaucaugccuugaugagcaucauuucaacuuuccacuuauccauuccaaauuucaaucaguaugaagcaaugaguugugacuuuaauggagggaaaauaagugugcaauacaaucucagucaugcuuaugcuguagaugcagccaaccacugugggaccauugccaacgguguccuacagacuuucaugagaauggcuuggggcggcaguuacauagcacuugauucuggaaaagggaacugggauugcauaaugacuuccuaucaguacuugauuauccaaaacaccaccugggaagaucacugucaguuuucccgcccguccccuauuggauaccuaggacuguuaucacaaaggacuagagauauuuacauuagucggagacuucuuggaacuuucaccuggacccucucugacucugagggcaaugaggcacccgguggauacugccuuacuagauggaugcuaauugaagcugaauugaagugcuuugggaacacagccauugcgaaguguaaugagaagcacgaugaggaauucugugacauguugagacuuuucgacuucaacaaacaagccauaaaaaggcuaaaagcagaagcacagaugagcauccaauugauaaauaaagcaguaaaugcacuaaucaaugaccaauugaucaugaagaaccacuugagggauaucauggggauucccuauugcaauuacagcaaguacugguaucugaaccauacugugacagggaaaacaucauugccaagguguuggcuuauuucaaaugguucuuaccuaaaugagacacauuucuccgaugauauugaacagcaagcagauaacaugauaacagaacugcugcaaaaggaguauauggacaggcaggggaaaacacccuuaggguuaguggaucuuuuuguuuucagcacuagcuuuuaucucauaaguaucuuccuccacuuagucaaaaucccgacccauaggcacauuguagggagaccuugccccaagccacacagacucaaccacaugggcauaugcucaugugguuuguacaaacauccugguguaccagucaaguggaagagauag

SEQ ID NO: 388 - RNA, 1473 nt, Artificial Sequence
  derived and/or modified CDS sequence (wt) from Lassa virus__ADU56618__GPC
augggacaaauugugacauucuuccaggaagucccucauguuaucgaggaagugaugaauaucguccucauagcauugucaauuuuggcaauccuaaaaggacucuacaacauugcuacauguggcuugauaggccuugucacauuccucuuacuuucuggaaggucauguucaaugaccuacaaaggaguuuaugaacuacagacccuugaacugaacaugaacacucugaauaugacuaugccgcuaucuuguacaaagaacaauagucaccacuacaucauggugggaaacgagacagggcuugagcucaccuuaaccaacacaagcuugcuccaucacaaauucugcaaccuaucagaugcucauaagaaaaaucuuuaugaucacacucucaugagcauuaucuccacauuccauuuguccauuccuaacuuuaaucaguaugaggcaaugaguugugauuuuaaugguggcaagaucacugugcaauacaaucugagucauagcuaugcaauugaugcagcaaaccauuguggcacaguggcaaacgguguguugcaaacauuuaugaggauggcuuggggagguaguuacauugcccuugauuccggacgugggaaaugggauuguauaaugaccaguuaucaauacuuaaucauccagaacacaaccugggaagaucauugucaauuuuccagaccauccccaauuggauaucuugggcuccucucacagagaacuagagacauauacauuaguagaagacuacuaggaacauuuacuuggacacuuucugacucagaaggaaaugagacaccaggagguuacugucucacuagauggauguugauugaggcugaacuaaaguguuucgggaauacagcuguagcuaagugcaaugaaaaacacgaugaagaguuuugugacaugcuaaggcuauuugacuucaauaagcaagcuauaaggagguuaaaggcagaggcccaaaugagcauacagcugaucaacaaagcaguuaaugcucuaauaaacgaucagcugaucaugaagaaucaucuaagggacaucaugggaauaccauacugcaauuacagcaaguacugguaucucaaucacaccucaacagggaggaccucauuaccgagauguuggcuuguuucaaaugggucauaucucaaugaaacucacuuuucagaugacauugagcagcaagcugauaacaugauaacugaaauguugcaaaaagaauaccuggacagacaaggaaagaccccauugggauugguagaucuuuuugucuucaguacaaguuuuuacuuaaucaguauuuuccuccaucuggucaaaauaccaacccauagacacauuguagggaagccuugccccaaaccucauagguugaaccacaugggcaucugcucuuguggucuauauaaacagccaggaguacccguuagauggaagagauaa

SEQ ID NO: 389 - RNA, 1473 nt, Artificial Sequence
  derived and/or modified CDS sequence (wt) from Lassa virus__ADU56622__GPC
augggacaaaucauaacauuuuuccaggaaguaccucaugucauagaggaagugaugaacauuguccugauugcccucagccuucuggcaauacugaaggggaucuacaauguugcuaccuguggccucuuuggauugguguccuuccuccucuuauguggaagaucauguucaacaacuuacaaggguguuuaugagcuacaaacucuggagcuagacauggcaagccuuaauaugacaaugcccuuaucuugcacgaagaacaacagccaccauuacauuauggucggaaaugagacuggcuuggagcugacuuuaacaaauacaaguaucaucaaccacaaauuuuguaaccucucugaugcacauaaaaagaaucuuuaugaucaugcuuuaaugaguaucauuucaaccuuccacuuauccauuccuaacuuuaaucaguaugaagcaaugaguugugacuucaauggggggaagauaaguguucaguacaaccuuagccacacuuaugcuguagaugcagccaaccacugugggacuaucgccaauggcguucuucagacuuuuaugaggauggcuugggguggcaguuauauagcacuugauuccggaaaggggaguugggacuguauaaugacuuccuaccaauauuugauaauccaaaacaccacuugggaagaucacugccaguuuucucgcccauccccuaucgguuaccuagggcuacugucacaaaggaccagggacauuuacaucagucgaagacuucuugggacuuuuacuuggacucucucugauucugaggguaaugaaacaccggguggguauugucuaacaagauggaugcugauugaggccgaguugaaaugcuuugggaacacagcaguugcgaaaugcaaugagaaacaugaugaagaguuuugugacauguuaagauuguuugacuuuaacaaacaagcuauaaggaggcuaaagacagaagcacagaugaguauccagcugauaaacaaagcagugaacgcacugaucaaugaccagcugaucaugaagaaucauuugagagauaucauggggauuccuuacugcaauuacagcaaguacugguaucuaaaucauacuguaacagggaagacaucguugccaaggugcuggcuugugucaaaugguuccuaccugaaugagacacauuuuucugaugacauugaacaacaagcagacaacaugauaacagaacugcugcaaaaggaguacauagacaggcaagggaaaacaccuuuaggguuaguagaucuuuuugucuucagcaccagcuuuuaucucauuagcaucuuccuccaccugguuaaaaucccaacccacagacaugucauaggaaaacccugcccuaaaccacacagacucaaccacaugggcauauguucauguggucuauacaaacaucccggugugccagucaaguggaaaagauag

SEQ ID NO: 390 - RNA, 1473 nt, Artificial Sequence
  derived and/or modified CDS sequence (wt) from Lassa virus__ADU56626__GPC
augggacaaaucauaacauuuuuccaggaagugccucaugucauagaggaagugaugaacauuguccugauugcucucagccuucuggcaauacugaaagggaucuacaauguugcuaccugcggccucuuuggauugguguccuuucuccucuuauguggaagaucaugcucaacaaccuacaagggugucuaugagcuacaaacucuagagcuaaacauggcaagccuuaauaugacaaugcccuuaucuugcacaaagaacaacagccaccauuacaucauggucggaaaugagacuggcuuggagcuaacuuuaacaaauacaaguauuaucaaucacaaguuuuguaaccuuucugaugcacauaaaaggaaucucuaugaccaugcuuuaaugaguaucauuucaaccuuccacuuaucuauucccaauuuuaaucaguaugaagcaaugagcugugacuucaauggggggaagauaaguguucaauacaaccuuagccacacuuaugcuguagaugcagccaagcacugugggacuaucgccaauggcguucuucagacuuuuaugaggauggcuugggguggcaguuacauagcacuugauuccggaaaggggaguugggauuguauaaugacuuccuaucaauauuugauaauccaaaacaccaccugggaagaucacugccaguuuucucgcccauccccuaucgguuaucuggggcuacugucacaaaggaccagggacauuuacaucagucgaagacuucuugggacuuucacuuggacucucucugacucugaagguaaugaaacgccggguggguauugucuaacaagauggaugcugauugaggcugaauugaagugcuuugggaacacagcaguugcgaaaugcaaugagaaacaugaugaagaguuuugugacauguugagacuguuugacuuuaauaaacaagcuauaaggaggcugaaggcagaagcacagaugaguauccaacugauaaacaaagcagugaacgcacugaucaaugaccagcuuauuaugaagaaucacuugagagauaucaugggaauuccuuacugcaauuacagcaaguacugguaucuaaaucacacuguaacagggaagacaucguugccaaggugcuggcuugugucaaaugguuccuaccugaaugagacacauuuuucugaugacauugaacaacaagcagacaacaugauaacagaacuguugcaaaaggaauacauagacaggcaagggaaaacacccuuaggguugguagaucuuuuugucuucagcaccagcuuuuaucucauuagcaucuuccuccaccuggucaaaaucccaacccacagacaugucauagggaaacccugcccuaaaccacacagacucaaccauaugggcauaugcucauguggucuauacaagcauccuggugugccagucaaguggaaaagauag

SEQ ID NO: 391 - RNA, 1473 nt, Artificial Sequence
  derived and/or modified CDS sequence (wt) from Lassa virus__ADU56630__GPC
auggggcaaaucauaacauuuuuccaggaaguaccucaugucauagaagaagugaugaacauuguccugauugcccucagccuucuggcaauauugaaagggaucuacaauguugcuaccuguggccucuuuggauugguguccuuucuucucuuguguggaagaucgugcucaacaacuuacaaagguguuuaugagcuacaaacucuagagcuagacauggcaagccuuaauaugacaaugcccuuaucuugcacaaagaauaacagccaccauuacaucauggucggaaaugagacuggcuuagagcugaccuuaacaaauacaaguaucaucaaucacaaauuuuguaaccuuucugaugcacauaaaaagaaucuuuaugaccaugcuuuaaugaguaucaucucaaccuuucauuuauccauuccuaacuuuaaucaguaugaagcaaugaguugugacuucaauggggggaagauaaguguucaguacaaccuuagccacgcuuaugcuguagaugcagcuaaccauugugggacuauugccaauggcguucuucagacuuucaugaggauggcuugggguggcaguuacauagcacuugauuccggaaaagggaguugggauuguauaaugacuuccuaccaauauuugauaauccagaacaccacuugggaagaucacugccaguuuucacgcccaucccccaucgguuaucuggggcuacugucacaaaggaccagggacauuuacaucagucgaagacuccuugggacuuuuacuuggacccucucugauucugaaggcaaugaaacaccggguggguauugucuaacaagauggaugcugauugaggccgaguugaagugcuuuggaaacacagcaguugcgaaaugcaaugagaaacaugaugaagaguucugugacauguuaagauuguuugacuucaacaaacaagcuauaaggaggcugaagacagaagcacagaugaguauccaauugauaaacaaagcagugaacgcacugaucaaugaccagcugauuaugaagaaucauuuaagagauaucaugggaauuccuuacugcaauuacagcaaguauugguauuuaaaucacacugugacagggaagacaucguugccaagaugcuggcuugugucaaaugguuccuaccugaaugagacacauuuuucugaugacauugaacaacaagcagacaacaugauaacagaacugcugcagaaggaguacauggacaggcaagggaaaacacccuuaggguugguagaucuuuuugucuucagcaccaguuuuuaucucauuagcaucuuccuucaccuggucagaaucccaacucacagacaugucauagggaaacccugcccuaaaccacacagacucaaccacaugggcauauguucauguggucuguacaaacauccugguguaccagucaaauggaaaagauag

SEQ ID NO: 392 - RNA, 1476 nt, Artificial Sequence
  derived and/or modified CDS sequence (wt) from Lassa virus__AFY05588__GPC
augggacaaauagugacauucuuccaggaagugccucauguaauagaagaggugaugaacauuguucucauugcacugucuguacuagcagugcugaaaggucuguacaauuuugcaacguguggccuuguugguuuggucacuuuccuccuguugugugguaggucuugcacaaccagucuuuauaaagggguuuaugagcuucagacucuggaacuaaacauggagacacucaauaugaccaugccucucuccugcacaaagaacaacagucaucauuauauaauggugggcaaugagacaggacuagaacugaccuugaccaacacgagcauuauuaaucacaaauuuugcaaucugucugaugcccacaaaaagaaccucuaugaccacgcucuuaugagcauaaucucaacuuuccacuuguccauccccaacuucaaucaguaugaggcaaugagcugcgauuuuaaugggggaaagauuagugugcaguacaaccugagucacagcuaugcuggggaugcagccaaccauugugguacuguugcaaaugguguguuacagacuuuuaugaggauggcuuggggugggagcuacauugcucuugacucaggccguggcaacugggacuguauuaugacuaguuaucaauaucugauaauccaaaauacaaccugggaagaucacugccaauucucgagaccaucucccaucgguuaucucgggcuccucucacaaaggacuagagaucuuuauauuaguagaagauugcuaggcacauucacauggacacugucagauucugaaggugaagacacaccagggggauauugucugaccagguggaugcuaauugaggcugaacuaaaaugcuucgggaacacagcuguggcaaaauguaaugagaagcaugaugaggaauuuugugacaugcugaggcuguuugacuucaacaaacaagccauucaaagguugaaagcugaagcacaaaugagcauucaguugaucaacaaagcaguaaaugcuuugauaaaugaccaacuuauaaugaagaaccaucuacgggacaucaugggaauuccauacuguaauuacagcaaguauugguaccucaaccacacaacuacugggagaacaucacugcccaaauguuggcuuguaucaaaugguucauacuugaacgagacccacuuuucugaugauauugaacaacaagcugacaauaugaucacugagauguuacagaaggaguauauggagaggcaggggaagacaccauugggucuaguugaccucuuuguguucagcacaaguuucuaucuuauuagcaucuuccuucaccuagucaaaauaccaacucauaggcauauuguaggcaagucgugucccaaaccucacagauugaaucauaugggcauuuguuccuguggacucuacaaacagccuggugugccugugaaauggaagagauga

SEQ ID NO: 393 - RNA, 1476 nt, Artificial Sequence
  derived and/or modified CDS sequence (wt) from Lassa virus__AFY05590__GPC
augggacaaauagugacauucuuccaggaagugccucauguaauagaagaggugaugaacauuguucucauugcacugucuguacuagcagugcugaaaggucuguacaauuuugcaacguguggccuuguugguuuggucacuuuccuccuguugugugguaggucuugcacaaccagucuuuauaaagggguuuaugagcuucagacucuggaacuaaacauggagacacucaauaugaccaugccucucuccugcacaaagaacaacagucaucauuauauaauggugggcaaugagacaggacuagaacugaccuugaccaacacgagcauuauuaaucacaaauuuugcaaucugucugaugcccacaaaaagaaccucuaugaccacgcucuuaugagcauaaucucaacuuuccacuuguccauccccaacuucaaucaguaugaggcaaugagcugcgauuuuaaugggggaaagauuagugugcaguacaaccugagucacagcuaugcuggggaugcagccaaccauugugguacuguugcaaaugguguguuacagacuuuuaugaggauggcuuggggugggagcuacauugcucuugacucaggccguggcaacugggacuguauuaugacuaguuaucaauaucugauaauccaaaauacaaccugggaagaucacugccaauucucgagaccaucucccaucgguuaucucgggcuccucucacaaaggacuagagauauguauauuaguagaagauugcuaggcacauucacauggacacugucagauucugaaggugaagacacaccagggggauauugucugaccagguggaugcuaauugaggcugaacuaaaaugcuucgggaacacagcuguggcaaaauguaaugagaagcaugaugaggaauuuugugacaugcugaggcuguuugacuucaacaaacaagccauucaaagguugaaagcugaagcacaaaugagcauucaguugaucaacaaagcaguaaaugcuuugauaaaugaccaacuuauaaugaagaaccaucuacgggacaucaugggaauuccauacuguaauuacagcaaguauugguaccucaaccacacaacuacugggagaacaucacugcccaaauguuggcuuguaucaaaugguucauacuugaacgagacccacuuuucugaugauauugaacaacaagcugacaauaugaucacugagauguuacagaaggaguauauggagaggcaggggaagacaccauugggucuaguugaccucuuuguguucagcacaaguuucuaucuuauuagcaucuuccuucaccuagucaaaauaccaacucauaggcauauuguaggcaagucgugucccaaaccucacagauugaaucauaugggcauuuguuccuguggacucuacaaacagccuggugugccugugaaauggaagagauga

SEQ ID NO: 394 - RNA, 1476 nt, Artificial Sequence
  derived and/or modified CDS sequence (wt) from Lassa virus__AHC95553__GPC
auggggcagauugugacauucuuucaagaagugccucauguaauagaagaagugaugaacaucguccuuauagcauuguccauauuggcaguguuaaaggguuuguacaacauugcuacauguggucucauuggcuuggucaccuucuuccuacugugugguagauccugcuccuccaaccucuauaagggggucuaugaacuccaaucucuagaucugaacauggagacacucaacaugacuaugccccucucuugcaccaaaaacaacagucaucauuacauaagaguuggcaaugagacagggcuggaacugaccuuaaccaacacaaguuugcuugaucauaaguucuguaaccugucggaugcccacaagaagaaucuuuacgaccacgcacucaugaguauaaucucaacuuuccaccuaucuauacccaacuucaaccaauaugaagcaaugagcugugacuuuaaugggggcaaaaucacuguccaguacaaccuaagccacucuuaugcaggggaugcagccaggcacugcggcacaauugcaaauggcguccugcagacuuucaugaggauggcaugggguggaagcuacauugcucuugacucaggccaugggaacugggacugcaucaugaccaguuaucaauaccugauaauccaaaacacaaccugggaagaccauugucaguucucaagaccaucucccaucggcuaccuuagucuccucucacagagaaccagagauaucuacauuagcagaagguuguuaggcacauucacauggacacugucagacuccgaggggaaugcuacaccaggagguuacugcuuaaccagguggauguugauugaggcugaauuaaaaugcuuuggcaacacagcaguggcaaagugcaaugaaaagcaugaugaggaauucugugacaugcucagacuguuugauuucaacaagcaggccauaagcagacugagaucugaagcacaaaugagcauccagcuuaucaacaaggcagugaaugccuuaauuaaugaucaguugauuaugaaaaaccauuugcgagacauuauggggaucccauauugcaauuacagcaaauacugguaucuuaaccacacagucacugguagaaccucacuaccuaaguguuggcuuguguccaauggcucauacuugaaugagacccauuuuucugaugacaucgaacagcaagccgacaacaugaucacagagaugcuacaaaaggaauacauggacaggcaaggaaaaacaccuuugggccugguugacuuguuuguguuuagcacaaguuuuuaucugauuagcauuuuccuucauuuagucaaaauaccgacccauagacacauuguggguaaaccgugucccaagccucacaggcugaaccgcaugggcauuugcucuugugguuuguacaagcaaccuggcgucccuguuaaauggaagagauag

SEQ ID NO: 395 - RNA, 1476 nt, Artificial Sequence
  derived and/or modified CDS sequence (wt) from Lassa virus__AHC95555__GPC
auggggcagauagugacauucuuucaagaagugccccauguuauagaggaagugaugaacauuguucucauagcacugucuauauuggcagugcugaaaggccuguacaacauugccacauguggucugauuggccuggucacuuuccuccugcuguguggaagauccuguuccuccaauuuauacaagggaguuuaugagcuccaaucucuggaccugaacauggaaacacucaacaugacuaugccucucucuugcaccaagaacaacagucaccauuauauaagagcugguaaugagacagggcuggagcugaccuugaccaacacuagcuugauuaaucacaaauucugcaaccuuucagaugcccacaaaaagaaccuguaugaccacacacucaugagcauaauuucaacuuuccaccuaucuauacccaacuuuaaucaguaugaagcaaugaguugugauuuuaaugggggcaagauuagugugcaauacaaucuaagccaugcuuaugcuauagaugcagccgagcacuguggcacaguugcaaauggugucuugcagaccuucaugagaauggcaugggguggaagcuacauugcucuugacucaggccgugggaacugggacuguaucaugaccaguuaucaguaucugauaauucagaacacaacuugggaagaucacugucaguuuucaagaccaucucccauugguuaucucggacuccucucacagagaaccagagacauuuacauaagcaggagguuguuggguacauucacauggacacugucagacuccgaggguaacgcuacaccaggggguuauugccuaacuagguggauguuaaucgaggcugaauugaaaugcuuuggaaauacagcgguagcaaagugcaaugagaagcaugaugaagaauucugugacaugcucagacuauuugauuucaauaagcaggccauaaguagguugaaauccgaagcacagaugagcauucaacugaucaacaaagcaguaaaugcuuugaucaaugaucaauugauuaugaaaaaccauuuacgggacauaauggggauuccauauuguaauuacagcaaauauugguaccucaaccauacaauuacuggcagaacuucauuacccaaguguuggcuugugucuaauggcucauaccugaaugagacccacuucucugaugauauagagcaacaagcugacaacaugaucacagagaugcuacaaaaggaauauauggaaaggcaggggaagacgcccuugggcuuagucgacuuguuugucuucagcacaagcuuuuaucugaucaguaucuuccuccaucuagucaagauuccgacccauagacacauuguagguaagccauguccuaagccccacaggcugaaccacauggguaucuguuccugugguuuauacaagcaaccuggugucccccucaaguggaagagauaa

SEQ ID NO: 396 - RNA, 1476 nt, Artificial Sequence
  derived and/or modified CDS sequence (wt) from Lassa virus__AHC95557__GPC
auggggcagauugugacauucuuucaagaagugccucauguaauagaagaagugaugaacaucguucuuauagcauuguccauauuggcaguguuaaaggguuuguacaacauugcaacauguggccucauuggcuuggucaccuucuuccuacugugugguagauccugcuccuccaaccucuauaagggggucuaugaacuccaaucccuagaucugaacauggagacacucaacaugacuaugccccucucuugcaccaaaaacaacagucaucauuacauaagaguuggcaaugagacagggcuggaacugaccuuaaccaacacaaguuugcuuaaucauaaguucuguaaccugucggaugcucacaagaggaaucuuuacgaccacgcacucaugaguauaaucucaacuuuccaccuaucuauacccaacuucaaccaauaugaagcaaugagcugugacuuuaaugggggcaaaaucacuguccaguacaaccuaagccacucuuaugcaggggauacagccaagcacugcggcacaaucgcaaauggcguccugcagacuuuuaugaggauggcaugggguggaagcuacauugcucuugacucaggccaugggaacugggacugcauuaugaccaguuaucaauaucugauaauccaaaacacaaccugggaggaccauugucaguucucaagaccaucucccaucggcuaccuuggucuccucucacagagaaccagagauaucuacauuagcagaagguuguuaggcacauucacauggacacugucagacuccgaggggaaugccacaccaggagguuacugcuuaaccagguggauguugauugaggcugaauuaaaaugcuuuggcaacacagcaguggcaaagugcaaugaaaagcaugaugaggaauucugugacaugcucagacuguuugauuucaacaagcaggccauaagcagacugagaucugaagcacaaaugagcauccagcuuaucaacaaggcagugaaugccuuaauuaaugaucaguugauuaugaaaaaccauuugcgagacauuauggggaucccauauugcaauuacagcaaauacugguaucuuaaccacacagucacugguagaaccucacuaccuaaguguuggcuuguguccaauggcucauacuugaaugagacucauuuuucugaugacaucgaacagcaagccgacaacaugaucacagagaugcuacaaaaagaauacauggacaggcaaggaaaaacaccuuugggccugguugacuuguuuguguuuagcacaaguuuuuaucugauuagcauuuuccuucauuuagucaaaauaccgacccauagacacauuguggguaaaccguguccuaagccucacaggcugaaccguaugggcauuugcucuugugguuuguacaagcaaccuggcgucccuguuaaauggaagagauag

SEQ ID NO: 397 - RNA, 1476 nt, Artificial Sequence
  derived and/or modified CDS sequence (wt) from Lassa virus__AHC95559__GPC
auggggcagauaauaacauucuuucaagaagugccccauguuauagaggaagugaugaacauuguucuuauagcauuguccauauuggcaguguuaaaaggcuuguacaacauugccacauguggucugauuggccuagucacuuuccuccugcuguguggaagauccugcuccuccagucuuuacaaaggagucuacgagcuccaaucccuggaccugaacauggagacacucaauaugacuaugccccucucuugcaccaaaaacaacagucaucauuauauaagaguuggcaaugagacaggguuggaguugaccuugaccaacacuagcuugaucaaucacaaguuuugcaaccuuucagaugcccacaagaagaaccuguaugaccacgcacucaugagcauaauuucaacuuuccaccuaucuauacccaacuucaaucaauaugaagcaaugaguugugauuucaaugggggcaaaauuaguguacaauacaaucuaagccaugcuuaugccauagaugcagccagccacuguggcacaguugcaaauggugucuugcagaccuucaugaggauggcaugggguggaaguuacauugcucuagauucaggccaugggaacugggacuguauuaugaccaguuaucaguaucugauaauccagaacacaacuugggaagaucacugucaauucucaagaccguccccuauugguuaucuuggucuccucucacagagaacuagagauauuuacauuagcaggagguugcugggcacauucacauggacacugucagacuccgaggguaaugcuacaccaggagguuauugccuaacuagguggauguuaauugaggcugaauugaaaugcuuuggaaauacagcgguggcaaagugcaaugagaagcaugaugaagaauucugugacaugcucagacuguucgauuucaauaagcaagccauaaguagguuaaaauccgaagcacaaaugagcauccaacuaaucaauaaagcagugaaugcuuugaucaaugaucaauuaauaaugaaaaaccacuuacgggacauaauggggauuccauauuguaauuacagcaaguauugguaccucaaccacacaguuacugguaaaaccucauugcccaaaugcuggcuuguguccaauggcucauacuugaaugagacccacuuuucugaugacaucgaacaacaagcugacaacaugaucacagagaugcuacaaaaggaauacauggagaggcaggggaagacgcccuuaggccugguugaucuauuugucuuuagcacaagcuuuuaucugaucaguaucuuccuccaucuagucaagauuccgacucauagacacauuguggguaaaccauguccuaaaccccacaggcugaaccacaugggcaucuguuccugugguuuguacaagcagccuggugucccugucaaauggaagagauag

SEQ ID NO: 398 - RNA, 1476 nt, Artificial Sequence
  derived and/or modified CDS sequence (wt) from Lassa virus__AIT17126__GPC
augggacagauagugacauucuuccaggaaguaccucauguaauagaagaggugaugaacauuguucucauugcacugucuauacuagcagugcugaaaggucuguauaauuuugcaacauguggccucguuggucuacucaccuuccuccuauuguguggcaggucuugcacaaccggacuuuacaaagggguuuaugagcuucaaacucuggaacuaaacauggagacacucaauaugaccaugccucucuccugcacaaagaacaacagucaucauuauauaaugguggguaaugagacaggacuagaacugacuuugacuaacacgagcaucauuaaucauaaauuuugcaaucugucugaugcccacaaaaagaaccuuuaugaccacgcucuuaugagcauaauuucaacuuuccacuuguccauccccaacuucaaucaguaugaggcaaugagcugcgauuuuaaugggggaaagauuaguguacaguacaaccugagccacaguuaugcuggggaugcggcugaucauuguggcacuguugcaaauggugucuugcagacuuucaugaggauggccuggggugggagcuacauugcucuugacucaggucguggcaggugggacuguauuaugacuaguuaucaauauuugauaauccaaaauacaaccugggaagaucacugccaguucucaagaccaucucccaucgguuaucucgggcuccucucacaaagaacuagagacauuuacauuaguagaaggcuacuaggcacauucacauggacacugucagauucugaaggcaaggacacaccaggaggauauugucugacuagauggaugcugauugaggcugaauuaaaaugcuucgggaacacagcuguagcaaaauguaaugagaagcaugaugaggaauuuugugacaugcugaggcuguuugacuucaacaaacaagccauucaaagguuaaaagcugaagcacagaugagcauucaauugaucaacaaggcaguaaaugcuuugauaaaugaccaacuuguaaugaagaaccacuuacgggacaucaugggaauuccauacuguaauuacagcagguauugguaucucaaccacacaaccacuggaagaacaucacugccuaaauguuggcuugugucaaauggcucauacuuaaacgagacccacuuuucugaugauauugagcaacaagcugacaacaugaucacugagauguuacagaaggaauauauggaaaggcagggaaagacaccauuaggucugguugaccucuuuguguucagcacaaguuucuaucuuauuagcaucuuccuucaccuggucaagauaccaacucauaggcauauugugggcaagucgugucccaaaccucauagauugaaucacaugggcauauguuccuguggacucuacaaacagcccgguguaccugugaaauggaagagauga

SEQ ID NO: 399 - RNA, 1476 nt, Artificial Sequence
  derived and/or modified CDS sequence (wt) from Lassa virus__AIT17130__GPC
augggacagauagugacauucuuccaggaagugccucauguaauagaagaggugaugaacauuguucucauugcacugucuauauuagcagugcugaaaggucuguacaauuuugcaacauguggcuuuguuggcuuggucacuuuccuccuguuguguggcaggucuuguacaaccagucuuuacaaaggggucuaugagcuucagacucuggaacuaaacauggagacacucaauaugaccaugccucucucuugcacaaagaacaacagucaucauuacauaaggguggguaaugacacaggacuagaacugaccuugaccaacacguccauuauuaaucauaaguuuugcaauuugucugaugcccacaaaaagaaccuuuaugaccacgcucuuaugagcauaauuucaacuuuccacuugucuauccccaacuucaaucaguaugaggcaaugagcugcgauuuuaaugggggaaagauuagugugcaguacaaccugagucacagcuaugcuguggaugcggccagccauuguggcacuauugcaaaugguguuuugcagaccuucaugaggauggcuuggggugggagcuacauugcccuugacucaggccgugacaggugggacuguauuaugacuaguuaucaauaucugauaauucaaaacacaaccugggaagaucacugccaauucucaagaccaucucccaucgguuaucucgggcuucucucacaaaggaccagagacaucuauauuaguagaagacuacuaggcacauucacauggacacugucagauucugaaggcaaggacacaccagggggauauugucugaccagauggaugcuaauugaagcugaacuaaaaugcuucgggaacacagcuguagcaaaguguaaugagaaacaugaugaggaauuuugugacaugcugaggcuguuugacuucaacaaacaagccauucaaagguugaaagcugaagcacagaugagcauucaguugaucaacaaggcaguaaaugcuuugauaaaugaccaacuuauaaugaagaaccaucuacgggacaucaugggaauuccauacuguaauuacagcaaguauugguaccuuaaucacacaacuacugggaaaacaucacuaccuaaauguuggcuugugucaaauggcucauacuugaacgagacccacuuuucugaugauauugagcaacaagcugacaacaugaucacugagauguuacagaaggaguauauggagaggcagggaaagacaccauugggucuaguugaccucuuuguguuuagcacaaguuucuaucucauuaguaucuuccuucaccuagucaaaauaccaacccauaggcauauugugggcaagucgugucccaagccccacagauugaaccacauggguauauguuccuguggacucuauaaacagcccggugugccugugaaauggaagagauga

SEQ ID NO: 400 - RNA, 1476 nt, Artificial Sequence
  derived and/or modified CDS sequence (wt) from Lassa virus__AIT17134__GPC
augggacagauagugacauucuuccaggaagugccucauguaauagaagaggugaugaacauuguucucauugcacuguccauacuggcagugcugaaaggucuguacaauuuugcaacauguggccucguugguuugguuacuuuccuccuguuguguggcaggucuugcacaacuagucuuuauaaagggguuuaugagcuucagacucuggaacuaaauauggagacacucaauaugaccaugccucucuccugcacaaagaacaacagucaucauuacauaaugguggguaaugagacaggacuggaacugaccuugaccaacacaagcauuauuaaucauaaauuuugcaaucugucugaugcccacaaaaagaaccucuaugaccaugcccuuaugagcauaauuucaacuuuccacuuguccauccccaacuucaaucaguaugaggcaaugagcugcgacuucaaugggggaaagauuagugugcaguacaaccugagucacagcuaugcuggggaugcggccaaccacuguggcacuguugcaaauggugucuuacagacuuucaugaggauggcuuggggugggaguuacauugcucuugacucaggccguggccggugggacuguauuaugacuaguuaucaauaucugauaauccaaaauacgaccugggaagaucacugccaauucucaagaccaucacccaucgguuaucucgggcuccucucacagaggaccagagauauuuauauuaguagaagacuacuaggcacauuuacauggacacugucagauucugaagguaaggacacaccagggggauauugucugaccagauggaugcuaauugaagcugaauuaaaaugcuucggaaacacagcuguagcaaaauguaaugagaagcaugaugaggaauuuugugacaugcuaaggcuguuugacuucaacaaacaggcuauucaaaggcugaaagcugaagcacaaaugaguauucaguugaucaacaaggcaguaaaugcuuugauaaaugaccaacuuauaaugaagaaccaucuccgggacaucauggggauuccauacuguaauuacagcaaguauugguaccucaaccacacaacuacugggaaaacaucacugcccaaauguuggcuuguaucaaauggcucauacuugaacgagacccacuuuucugaugauauugaacaacaagcugacaacaugaucacugagauguugcagaaggaguauauggagaggcaggggaagacaccauugggccugguugaccucuuuguguucagcacaaguuucuaucucauuagcaucuuccuucaccuaguuaaaauaccaacucauaggcauauuguaggcaagucaugucccaaaccucacagauugaaucauaugggcauauguucuuguggacucuauaaacaacccggugugccugugaaguggaagagauga

SEQ ID NO: 401 - RNA, 1476 nt, Artificial Sequence
  derived and/or modified CDS sequence (wt) from Lassa virus__AIT17138__GPC
auggggcaaauagugacauucuuccaggaagugccucauguaauagaagaggugaugaacauuguucucauugcacuguccauacuggcagugcugaaaggucuguacaaucuugcaacauguggccucguugguuuggucacuuuccuccuguugugugguaggucuugcacaaccagucuuuacaaagggguuuaugagcuucagacucuggaacuaaacauggagacacucaacaugaccaugccucucuccugcacaaagaacaacagucaucauuauauaaugguggguaaugagacaggacuagaacugaccuugaccaacacgagccuuauuaaucacaaauuuugcaaccugucugaugcccacaaaaagaaccucuaugaccacgcucuuaugagcauaaucucaacuuuccacuuguccauccccaacuucaaucaguaugaggcaaugagcugcgauuuuaaugggggaaagauuagugugcaguacaaccugagucacagcuaugccguggaugcagccagccauuguggcacuguugcaaaugguguacuacagacuuucaugaggauggcuuggggugggagcuacauugcucuugacucaggccgugguggaugggacuguauuaugacuaguuaucaauaucugauaauccaaaauacaacuugggaagaucacugccaauucucgagaccaucuccuaucgguuaucucgggcuccucucacaaaggaccagagauauuuauaucaguagaagacuacuaggcacauucacauggacauugucagauucugaaggcaaggacacaccagggggauauuguuugaccagauggaugcugauugaggcugaacuaaaaugcuucgggaauacagcuguggcaaaauguaaugagaaacaugaugaggaauuuugugacaugcugaggcuguuugacuucaacaaacaagccauucaaagguugaaagcugaagcacaaaugagcauucaguugaucaacaaagcaguaaaugcuuugauaaaugaucaacuuauaaugaagaaccaucuacgggauaucaugggaaucccauacuguaauuacagcaaguauugguaccucaaccacacaacuacugggagaacaucacugccuagauguuggcuuguaucaaaugguucauaccugaacgagacccacuuuucugaugauauugaacaacaagcugacaacaugaucacugagauguuacagaaggaguauauggaaaggcaggggaagacaccauugggccuaguugaucucuuuguguuuagcacaaguuucuaucucauuagcaucuuucuucaccuagucaaaauaccaacgcauaggcauauuguaggcaagucgugucccaaaccucacagacugaaucacaugggcauuuguuccugugggcuuuauaaacagccuggugugccuguaaaauggaagagauga

SEQ ID NO: 402 - RNA, 1476 nt, Artificial Sequence
  derived and/or modified CDS sequence (wt) from Lassa virus__AIT17142__GPC
augggacaaauagugacauucuuccaagaagugccccauguaauagaagaggugaugaacauuguucucauugcacuaucuguacuagcaguguugaaaggucuguacaauuuugcaacauguggcauuguuggcuuggucacuuuccuccuguuguguggcaggucuugcacaacuagccuuuacaaagggguuuaugagcuucagacccuggaacuaaacauggaaacacucaacaugaccaugccucucuccugcacaaagaacaacagucaucauuauauaauggugggcaaugauacaggacuagaacuaaccuugaccaacacgagcauuauuaaucauaaauuuugcaaucugucugaugcccacaaaaagaaccucuaugaccacgcucuuaugagcaucaucucaacuuuccacuuguccaucccuaacuucaaucaguaugaggcaaugagcugcgauuuuaaugggggaaagauuaguguucaguacaaccugagucacagcuaugccggagaugcagccgaccauuguggcacuguugcaaaugguguauuacagacuuucaugaggauggcuuggggugggagcuacauugcucuugacucaggccguggcaggugggacuguauuaugacuaguuaucaauaucugauaauccaaaauacaaccugggaagaucauugccaauucucgagaccaucuccuaucgguuaucucgggcuccucucacaaaggaccagggauauuuauauuaguagaaggcuacuagguacauucacauggacacugucagacucugaaggcaaggacacaccagggggauauugucuaaccagauggaugcuaauugaggcugaacuaaagugcuucgggaacacagcuguggcaaaauguaaugagaaacaugaugaggaauuuugugacaugcugaggcuguuugacuucaacaaacaagccauucaaagauugaaagcugaagcacaaaugagcauucagcugaucaacaaagcagugaaugcuuugauaaaugaccaacuuauaaugaagaaccaucuacgggacaucauggggauuccguacuguaauuacagcaaguauugguaccucaaccacacaacuacugggaaaacaucacugcccaaauguuggcuuguaucaaaugguucauaccugaacgagacccacuuuucugaugauauugaacaacaagcugacaacaugaucacugagauguuacagaaggaguauauggagaggcaggggaagacaccguugggucuaguugaccucuuuguguucaguacaagcuucuaucucauuagcaucuuucuucaccuaguuaaaauaccaacucauaggcauauuguaggcaagccgugucccaaaccucacagguugaaucauaugggcauuuguuccuguggacucuacaaacagccuggugugccugugaaguggaagagauga

SEQ ID NO: 403 - RNA, 1476 nt, Artificial Sequence
  derived and/or modified CDS sequence (wt) from Lassa virus__AIT17146__GPC
augggacaaauagucacauucuuucaggaagugccccauguaauagaagaggugaugaacauuguucucauugcacugucuauacuagcagugcugaaaggucuguacaaucuugcaacauguggccucguuggcuuggucacuuuccuccuguuauguggaaggucuuguacaaccagccuuuacaaagggguuuaugagcuucagacucuggaacuaaacauggaaacacucaacaugacuaugccucucuccugcacaaagaacaacagucaucauuauauaaugguggguaaugagacaggauuagaacugaccuugaccaacacgagcauuauuaaccauaaauuuugcaaucugucugaugcccacaaaaagaaccucuaugaccacgcccuuaugagcauuaucucaacuuuccacuuguccauccccaacuucaaucaguaugaggcaaugagcugcgauuuuaaugggggaaagauuagugugcaguacaaccugagucauagcuaugccggggaugcagccaaccauuguggcacuguugcaaaugguguguuacagaccuucaugaggauggcuuggggugggagcuacauugcucuugacucaggccguggcaggugggacuguaucaugacuaguuaucaauaucugauaauccagaauacaaccugggaagaucacugcaguuucucgagaccaucucccaucgguuaucucgggcuccucucacaaaggaccagagauauuuauauuaguagaaggcugcuaggcacauucacauggacacugucagauucugaaggcaaggacacaccagggggauauugucugaccagauggaugcuaauugaggcugaacuaaagugcuuugggaauacagccguggcaaaauguaaugagaagcaugaugaggaauuuugugacaugcugaggcuguuugacuuuaacaaacaagccauucaaagguugaaagcugaagcacaaaugagcauucaguugaucaacaaagcaguaaaugcuuuaauaaaugaccaacuuauaaugaagaaccaucuacgggacaucauggggauuccauacuguaauuacagcaaguauugguaccucaaccacacaacuacugggaaaacaucacugccuaaauguuggcuuguaucaaaugguucauaccugaaugagacccacuuuucugaugauauugaacaacaagcugacaacaugaucacugaaauguuacagaaggaguauauggagaggcagggaaagacaccauugggucuaguugaccucuuuguguuuagcacaaguuucuaucucaucagcaucuuccuucaccuagucaaaauaccaacucauaggcauauugugggcaagucaugucccaaaccucacagguugaaucauaugggcauuuguuccuguggauucuauaaacaaccuggugugccugugaaauggaagagauga

SEQ ID NO: 404 - RNA, 1476 nt, Artificial Sequence
  derived and/or modified CDS sequence (wt) from Lassa virus__AIT17154__GPC
augggacagauagugacauucuuccaggaagugccucauguaauagaagaggugaugaacauuguucucauugcacugucuauacuagcaguccugaagggucuguacaacuuugcaacauguggcaucguugguuuggucagcuuucuccuguuguguggcaggucuugcacaaccagucuuuacaaagggguuuaugagcuucagacucuggagcuaaacauggagacacuuaacaugaccaugccucucucuugcacaaagaacaacagucaucauuauauaauggugggcaaugagacgggauuggaacugaccuugaccaacacgagcauuaucaaucauaaauuuugcaaucuaucugaugcccauaagaagaaccucuaugaccacgcccuuaugaguauaaucucaaccuuccacuuguccauccccaacuucaaucaguaugaagcaaugagcugugauuucaaugggggaaagauuaguguacaguacaaccugagucacagcuaugcuggggaugcagccaaccauuguggcacaauugcaaauggugucuuacagacuuucaugaggauggccuggggugggagcuacauugcucuugacucaggccgugacaggugggacugcauaaugaccaguuaucaauaucugauaauccaaaacacaaccugggaagaucacugccaauucucaagaccaucucccaucgguuaucuugggcuccucucacaaaggaccagagauauauauauuaguaggagacuacugggcacauuuacauggacauugucagauucugaagguaaggacacaccaggaggguauugucuaaccagauggaugcugauugaggcugagcugaaaugcuuugggaacacagcuguggcaaaaugcaaugagaaacaugaugaggaauuuugugauaugcuaaggcuguuugacuucaacaaacaagccauucaaagguuaaaagcugaggcacaaaugagcauucaguugaucaacaaagcagugaaugcuuugauaaacgaccaacuaauaaugaagaaccaucuacgggacaucaugggaauuccauacuguaauuacagcaaguacugguaccucaaccacacaacuacugggaaaacaucacugccuaaauguuggcuugugucgaaugguucauacuuaaacgagacucacuuuucugaugacauugaacaacaagcugacaauaugaucacugagauguuacagaaggaauacauggaaaggcaggggaagacaccauugggucuaguugaccucuuuguguucagcacaaguuucuaucucauuagcaucuuccuucauuuggucaaaauaccaacucauaggcauguuguaggcaagucgugucccaagccucacagauugaaucacaugggcauaugcuccugcggacucuauggacagccugguguaccugugaaauggaagagauga

SEQ ID NO: 405 - RNA, 1476 nt, Artificial Sequence
  derived and/or modified CDS sequence (wt) from Lassa virus__AIT17158__GPC
augggacagauagugacauucuuccaggaagugccucauguaauagaagaggugaugaacauuguucucauugcacuguccauacuggcagugcugaaaggucuguacaauuuugcaacauguggccucguugguuugguuacuuuccuccuguuguguggcaggucuugcacaacuagucuuuauaaagggguuuaugagcuucagacucuggaacuaaauauggagacacucaauaugaccaugccucucuccugcacaaagaacaacagucaucauuacauaaugguggguaaugagacaggacuggaacugaccuugaccaacacaagcauuauuaaucauaaauuuugcaaucugucugaugcccacaaaaagaaccucuaugaccaugcccuuaugagcauaauuucaacuuuccacuuguccauccccaacuucaaucaguaugaggcaaugagcugcgacuucaaugggggaaagauuagugugcaguacaaccugagucacagcuaugcuggggaugcggccaaccacuguggcacuguugcaaauggugucuuacagacuuucaugaggauggcuuggggugggaguuacauugcucuugacucaggccgugaccggugggacuguauuaugacuaguuaucaauaucugauaauccaaaauacgaccugggaagaucacugccaauucucaagaccaucacccaucgguuaucucgggcuccucucacagaggaccagagauauuuauauuaguagaagacuacuaggcacauuuacauggacacugucagauucugaagguaaggacacaccagggggauauugucugaccagauggaugcuaauugaagcugaauuaaaaugcuucggaaacacagcuguagcaaaauguaaugagaagcaugaugaggaauuuugugacaugcuaaggcuguuugacuucaacaaacaggcuauucaaaggcugaaagcugaagcacaaaugaguauucaguugaucaacaaggcaguaaaugcuuugauaaaugaccaacuuauaaugaagaaccaucuccgggacaucauggggauuccauacuguaauuacagcaaguauugguaccucaaccacacaacuacugggaaaacaucacugcccaaauguuggcuuguaucaaaugguucauacuugaacgagacccacuuuucugaugauauugaacaacaagcugacaacaugaucacugagauguugcagaaggaguauauggagaggcaggggaagacaccauugggccugguugaccucuuuguguucagcacaaguuucuaucucauuagcaucuuccuucaccuaguuaaaauaccaacucauaggcauauuguaggcaagucaugucccaaaccucacagauugaaucauaugggcauauguucuuguggacucuauaaacaacccggugugccugugaaguggaagagauga

SEQ ID NO: 406 - RNA, 1476 nt, Artificial Sequence
  derived and/or modified CDS sequence (wt) from Lassa virus__AIT17164__GPC
augggacaaauagugacauucuuucaggaagugccucauguaauagaagaggugaugaacauuguucucauugcacucucuauacuagcagugcugaaaggucuguacaauuucgcaacauguggccucguugguuuggucacuuuccuccuguugugugguaggucuugcacaagcagucucuauaagggaguuuaugagcuucagacucuagaacuaaacauggagacacucaauaugaccaugccucucuccugcacaaagaacaacagccaccauuauauaagggugggcaaugagacaggacuagagcugaccuugaccaacacgagcauuauugaucauaaauuuugcaaucugucugaugcccacaaaaagaaccucuaugaccacgcucuuaugagcauaaucucaacuuuccauuuguccaucccuaacuucaaucaguaugaggcaaugagcugcgauuuuaaugggggaaagauuagugugcaguacaaccugagucacaguuaugcuggggaugcagccaaacauuguggcacuguugcaaauggugugcugcagacuuucaugaggauggcuuggggugggagcuacauugcucuugacucaggccauggcaacugggacuguauuaugacuaguuaucaauauuugauaauccaaaauacaaccugggaagaucacugccaauucucgagaccaucucccaucgguuaucucgggcuccucucacaaaggaccagagauauuuauauuaguagaagacugcuaggcacauucacauggacauugucagauucugaaggcaaugaugcaccagggggauauugucugacuagauggaugcugauucaggcugaacuaaaaugcuucgggaacacagcuguggcaaaauguaaugagaagcaugaugaggaguuuugugacaugcugaggcuguuugacuucaacaaacaggccauucaaagguugaaagcugaagcacaaaugagcauucaguugaucaacaaagcagugaaugcuuuaauaaaugaucaacuuauaaugaagaaccaccuacgggacauuaugggaauuccauacuguaauuacagcaaguauugguaccucaaccacacgacuacugggagaacaucacugcccagauguuggcuuguaucaaaugguucuuauuugaacgagacccacuuuucugaugauauugaacaacaagcugacaacaugaucacugagauguuacagaaggaguacauggagaggcaaggaaagacaccauugggucugguugaccuauuuguguucaguacgaguuucuaucucauuagcaucuuccuucaccuagucaaaauaccaacucauaggcauauuguaggcaagucguguccuaaaccucacagguuaaaccacaugggcauauguucuuguggucucuuuaaacagccuggugugccugugaaauggaagagauga

SEQ ID NO: 407 - RNA, 1476 nt, Artificial Sequence
  derived and/or modified CDS sequence (wt) from Lassa virus__AIT17168__GPC
augggacagauagugacauucuuccaggaagugccucauguaauagaagaggugaugaacauuguucucauugcacugucuauacuagcagugcugaaaggucuguacaauuuugcaacauguggccucguuggucuacucacuuuccuccuguuguguggcagaucuugcacagcuagucguuacaaagggguuuaugagcuucagacucuggaacuaaacauggagacacucaauaugaccaugccucucuccugcacaaagaacaacagucaucauuauauaaugguggguaaugagacaggacuagaacugacuuugacuaacacgagcaucauuaaucauaaauuuugcaaucugucugaugcccacaaaaagaaccuuuaugaccacgcucuuaugagcauaauuucaacuuuccacuuauccauccccaacuucaaucaguaugaggcaaugagcugcgauuuuaaugggggaaagauuagugugcaguacaaccugagucacagcuaugcuggggaugcagccaaucauugugguacuguugcaaauggugucuugcagaccuucaugaggauggcuuggggugggagcuacauugcucuugacucaggccauggcaguugggacuguauuaugacuaguuaucaauaucugauaauccaaaauacaaccugggaagaucacugccaguucucaagaccaucucccauugguuaucucgggcuccuuucacaaagaaccagagauauuuacauuaguagaagacuacuaggcacauucacauggacacugucagauucugaaggcaaggacacaccagggggauauugucugaccagauggaugcuaauugaagcugaacuaaaaugcuucgggaacacagcuguggcaaaauguaaugagaagcaugaugaggaauuuugugacaugcugaggcuguuugacuucaacaaacaagccauucaaagguugaaagcugaagcacaaaugagcauucaauugaucaacaaggcaguaaaugcuuugauaaaugaccaacuuauaaugaagaaccauuuacgagacaucaugggaaucccauacuguaauuacagcaaguauugguaccucaaccacacaaccacugggaaaacaucacugccuaaguguuggcuuguaucaaaugguucauacuuaaaugagacccacuuuucugaugauauugagcaacaagcugacaacaugaucacugagauguuacagaaggaguauauggaaaggcagggcaagacaccauugggccuaguugaccucuuuguguuuagcacaaguuucuaucucauuagcaucuuccuucaccuggucaaaauaccaacucauaggcauauuguaggcaagucgugucccaaaccucauagauugaaucacaugggcauauguuccuguggacucuacaaacagcccggugugccugugaaauggaagagauga

SEQ ID NO: 408 - RNA, 1476 nt, Artificial Sequence
  derived and/or modified CDS sequence (wt) from Lassa virus__AIT17172__GPC
augggacaaauagugacauucuuccaggaagugccccaugucauagaagaggugaugaacaucguucucauugcacugucuauacuagcaguguugaaagguuuguacaauuuugcaacauguggccucguuggcuuggucacuuuccuccuguuguguggcaggucuugcacaacuagccuuuacaaggggguuuaugagcuucagacucuggaacuaaacauggaaacacucaauaugaccaugccucucuccugcacaaagaacaauagucaucauuauauaauggugggcaaugagacaggacuagaacugaccuugaccaacacgagcauuauuaaccauaaauuuugcaaucugucugaugcccacaaaaagaaccucuaugaccacgcucuuaugagcauuaucucaacuuuccacuuguccaucccuaacuucaaucaguaugaggcaaugagcugcgauuucaaugggggaaagauuaguguacaguacaaccugagccacagcuaugccggggacgcagccaaccauuguggcacuguugcaaaugguguauuacagacuuucaugaggauggcuuggggugggagcuacaucgcucuugacucaggccguggcaggugggacuguauuaugacuaguuaucaauaucugauaauccaaaauacaaccugggaagaucacugccaauucucgagaccaucucccaucgguuaucucgggcuccuuucacaaaggaccagagauauuuauauuaguagaaggcuacuaggcacauucacauggacacugucagauucugaaggcaaggacacaccagggggauauugucuaaccagauggaugcuaauugaggcugaguuaaagugcuucgggaacacagcuguggcaaaauguaaugagaagcaugaugaggaauuuugugacaugcugagguuauuugacuuuaacaaacaagccauucaaagguugaaagcugaggcacaaaugagcauucaguugaucaacaaagcaguaaaugcuuugauaaaugaccaacuuauaaugaagaaccaucuacgggacaucauggggauuccauauuguaauuacagcaaguauugguaccucaaccacacaacuacuggaaaaacaucacugcccaaguguuggcuuguaucaaaugguucauaccugaacgagacccacuuuucugaugacauugaacaacaagcugacaacaugaucacugagauguuacagaaggaguauauggagaggcaggggaagacaccauugggucugguugaccucuuuguguucagcacaagcuucuaucucauuagcaucuuccuucaccuaguuaaaauaccaacucauaggcauauuguaggcaagccgugucccagaccucacagguugaaucauaugggcauuuguuccuguggacucuauaaacagccuggugugccuguaaaauggaagagauga

SEQ ID NO: 409 - RNA, 1476 nt, Artificial Sequence
  derived and/or modified CDS sequence (wt) from Lassa virus__AIT17176__GPC
auggggcagauagucacguuuuuccaagaagugccucauguuauagaggaagugaugaacauugugcucauugcacugucuuugcuagcagugcugaaaggcuuguacaauguugcaacauguggucucauugguuugaucaccuuccuuuuguugugugguaggucuuguacaaccaaucuuuacaagggagucuaugagcuucaagcccuggaauuaaacauggagacgcucaacaugaccaugccucucuccugcacaaagaacaauagucaccacuauauaaugguaggcaaugaaacaggauuggagcugaccuuaaccaacacaagcauuaucaaucacaaguuuugcaaccugucugaugcccacaaaaagaaccucuaugaucacgccuuaaugagcauaaucucaacuuuccacuuauccauuccuaacuuuaaucaguaugaagcaaugagcugcgauuucaaugggggaaggaucagugugcaguauaaccuaagucacagcuaugcuggggaugcagccagccauugugguacaauugcgaaugguguuuugcagacuuuuaugaggauggcuuggggugggaguuauauugcucuugauucaggccaugguggaugggacugcaucaugacuaguuaccaauaucugauaauucagaacacaaccugggaagaucacugccaguucucaagaccgucuccuaucggcuaccucgggcuccuuucacaaagaaccagagacauuuauaucaguagaagacuacugggcacauucacauggacauugucagauucugaaggcaaggauacaccagggggguacugucuaacuagguggaugcugauugaagcugaauugaaaugcuuuggcaacacagcuguggccaaauguaaugaaaagcaugaugaggaauuuugugauauguugagacuguuugacuucaacaaacaagccauucaaaggcugaaagcagaagcacagaugagcauccagcugaucaauaaagcgguaaaugccuugauaaaugaccaacuaauaaugaaaaaccaucugcgagacauuauggggauuccauacuguaacuacagcaaguauugguaucucaaccacacagucacugggaaaacaucguugccuaagugcuggcuugugucaaauggcucauaucugaacgaaacccacuucucugaugauauugagcaacaggccgacaacaugauaacugagaugcugcagaaggaauacauggagaggcaggggaagacaccauuaggccugguugaccucuuuguguucagcacaaguuuuuaucucaucaguaucuuccuucaccuagucaaaauaccgacucauaggcauguuguaggaaaaccguguccuaaaccucacagacugaaucacaugggcauaugcucuugugggcucuacaagcaaccugguguaccuguaagauggaagagauga

SEQ ID NO: 410 - RNA, 1476 nt, Artificial Sequence
  derived and/or modified CDS sequence (wt) from Lassa virus__AIT17180__GPC
augggacaaauagugacauucuuucaggaagugccucaugugauagaggagguaaugaacauugugcucauugcacuauccauacuggcagugcugaagggucuauacaauguugcaacaugcggccugauugguuuagucaccuuccuauuguuaugugguaggucuugcacaacaacucuuuacaaaggaguuuacgaacuucagacucuggaauuaaacauggagacacucaauaugacuaugccucucucuuguacaaagaacaacagucaccacuauauaaggguggguaaugagacaggacuagaguugacccugaccaacacaagcaucaucaaucacaaguuuugcaaucuaucugaugcucacaaaaagaaccucuaugaucaugcuuugaugagcauaaucucgacuuuucacuuguccauucccaacuucaaccaauaugaggcaaugagcugugacuucaauggagggaagauuagugugcaguauaaccugagucacagcuaugcuggagaugcagccaaccauugugguacaguugcaaaugguguuuuacaaaccuucaugaggauggcuuggggugggaguuacaucgcccuugacucaggucguggcaauugggacuguauuaugacuaguuaucaauaccuaauaauucagaauacgaccugggaugaucauugccaauucucaagaccaucccccaucgguuaucuugggcuccucucacaaaggaccagagauguuuauaucaguagaagacugcuaggcacauucacauggacacugucagauucugaaggcaaggacacaccaggaggguacugucugaccagguggaugcuaauugaagcugaacugaaaugcuuuggcaacacagcuguagcaaaauguaaugagaaacaugaugaagaauucugugacaugcuaaggcuguuugacuucaauaaacaagcuauucagagguugaaagccgaagcacaaaugaguauucaguugaucaacaaagcagugaaugcuuugauaaaugaccaacuaauaaugaaaaaccaucuacgggacaucauggggauuccauacugcaauuacagcaaguacugguaucucaacaacacagccacugggaaaacaucacugcccaaauguuggcuuauaucaaauggcucauauuugaacgaaacucacuucucugaugacauugaacaggaagcugacaauaugaucacugagauguuacaaaaagaauacauggagaggcaggggaagacaccauuaggucugguugaccucuuuguguucagcacaaguuucuaucucauuagcaucuuccuucaccuagucaaaauaccaacucacaggcauauugugggcaaaucauguccuaaaccccauagguugaaucacauggguauuugcucuuguggacuuuauaaacaacccggugugccuguaagauggaagagauga

SEQ ID NO: 411 - RNA, 1476 nt, Artificial Sequence
  derived and/or modified CDS sequence (wt) from Lassa virus__AIT17184__GPC
augggacaaauagugacauuuuuccaggaagugccucaugugauagaggaagugaugaacauuguacucaucgcacugucuauucuugcaguguugaaggguuuguacaauguugcaacauguggccuuauugguuugguuaccuuucuuuuacugugugguagaucuugcacaaccacucuguacaaaggagucuaugaacuucaggcccuggaauuaaacauggagacacucaauaugaccaugccucucucuugcacaaagaacaauagucaccacuauauaaggguggguaaugagacaggacuagaacuaacccugaccaacacaagcaucaucgaucauaaguuuugcaacuugucugaugcccacaaaaagaaccuuuaugaucaugcacuuaugagcauaaucucaacuuuccacuuguccauuccuaacuuuaaucaauaugaagcaaugaguugugacuuuaauggagggaaaauuagugugcaguacaaccuaagucacagcuaugcuggagaugcagccaaccauuguggcacaguugcaaauggcguuuugcagaccuucaugaggauggccuggggugggagcuacauugcucuugauucaggccgcaauggaugggauugcauuaugacuaguuaucaauaucugauaauucagaauacaaccugggacgaucacugccaauucucaagaccaucucccauugguuaccuugggcuccucucacaaagaaccagagacaucuacauuagcaggagacuguugggcacauucacauggacacugucagauucugaagguaaggacacaccagggggguacugucugaccagauggaugcuaauugaggcugaacuuaaauguuucggcaacacagcuguggccaaauguaaugagaagcaugaugaagaauucugugacaugcugaggcuauuugauuucaacaaacaagcuauccgaagguugaaggcugaagcacaaaugagcauucaguugaucaacaaggcugugaacgcuuuaauaaaugaucaacugauaaugaaaaaccaucugcgggauaucauggggauuccauacuguaauuacagcaaguacugguaucucaacaacacagccacugggaaaacaucacugccuagaugcuggcuugugucaaauggcucauaccuaaaugagacccacuucucugaugacauugaacaacaagcugacaacaugaucacugagauguuacaaagggaguacauggagagacagggaaagacaccauuaggucuggucgaccucuuuguguucagcacaaguuuuuaucuuauuaguaucuuccuucaccuagucaaaauaccaacucauagacacauugugggcaaaccgugucccaaaccucacagguugaaucauaugggcauaugcuccuguggacucuauaaacaaccugguguaccuguaaaauggaagagauaa

SEQ ID NO: 412 - RNA, 1476 nt, Artificial Sequence
  derived and/or modified CDS sequence (wt) from Lassa virus__AIT17188__GPC
augggacaaauagugacauuuuuccaggaagugccucauguuauagaagaagugaugaacauuguucucauugcacuguccauacuagcagugcugaagggucuguacaacuuugcaacauguggcuucguugguuuggucaguuuccucuuguuguguggcaggucuugcacaaccagucuuuacaaagggguuuaugagcuucagacucuggaguuaaacauggagacacucaacaugaccaugccucucucuugcacaaagaacaacagucaucauuacauaauggugggcaaugagacaggacuggaauugaccuugaccaacacgagcauuauuaaucauaaauuuugcaaucugucugaugcccauaagaagaaccucuaugaucacgcucuuaugagcauaaucucaaccuuccacuuguccauccccaacuucaaucaguaugaagcaaugagcugugauuuuaaugggggaaagauuaguguacaguacaaccugagucacagcuaugcuguagaugcagccaaccauuguggcacaguugcaaauggugucuuacagacuuucaugaggauggccuggggugggagcuauauugcucuugacucaggccauggcagcugggacugcauaaugaccagcuaucaauaucugauaauccaaaacacaaccugggaagaccacugccaauucucaagaccaucucccaucggcuaucuugggcuccucucacaaaggaccagagauaucuauauuaguaggagacuacuggguacauucacauggacacugucagauucugaaggcaaggacacaccagggggguauugucugacaagguggaugcuaauugaagcugaauugaaaugcuucgggaacacagcuguggcaaaauguaaugagaaacaugaugaggaauuuugugacaugcugaggcuguuugacuucaacaaacaagccauucaaagguuaagagcugaggcacaaaugagcauucaguugauuaacaaagcagugaaugcuuugauaaaugaccaacuaauaaugaagaaccaucuacgggacaucauggggauuccauacuguaauuacagcaaguacugguaccuuaaccacacaacuacugggagaacaucacuacccaaauguuggcuuguaucgaaugguucauacuuaaacgagacccacuuuucugaugauauugaacagcaagcugacaacaugaucacugagauguuacaaaaagaguacauggaaaggcaggggaagacaccauugggucuaguugaccucuuuguguucagcacaaguuucuaucucauuagcaucuuccuucauuuagucaagauaccaacucauaggcauauuguaggcaagucgugucccaaaccucacagauugaaucauaugggcauaugcuccugcggacucuauggacagcccggugugccugugaaauggaagagauga

SEQ ID NO: 413 - RNA, 1476 nt, Artificial Sequence
  derived and/or modified CDS sequence (wt) from Lassa virus__AIT17192__GPC
augggacaaauagugacauuuuuccaggaagugccucauguuauagaagaagugaugaacauuguucucauugcacuguccauacuagcagugcugaagggucuguacaacuuugcaacauguggcuucauugguuuggucaguuuccucuuguuguguggcaggucuugcacaaccagucuuuacaaagggguuuaugagcuucagacucuggaguuaaacauggagacacucaacaugaccaugccucucucuugcacaaagaacaacagucaucauuacauaauggugggcaaugagacaggacuggaacugaccuugaccaacacgagcauuauuaaucauaaauuuugcaaucugucugaugcccauaagaagaaccucuaugaucacgcucuuaugagcauaaucucaaccuuccaccuguccauccccaacuucaaucaguuugaagcaaugagcugugauuuuaaugggggaaagauuaguguacaguacaaccugagucacagcuaugcuguggaugcagccaaccauuguggcacaguugcaaauggugucuuacagacuuucaugaggauggccuggggugggagcuacauugcucuugacucaggccauggcagcugggacugcauaaugacuaguuaucaauaucugauaauccaaaacacaaccugggaagaccacugccaauucucaagaccaucuccuaucgguuaucuugggcuccucucacaaaggaccagagauaucuauauuaguaggagacuacuggguacauucacauggacacugucagauucugaaggcaaggacacaccagggggguauugucugacaagguggaugcuaauugaagcugaacugaaaugcuucgggaacacagcuguggcaaaauguaaugagaaacaugaugaggaauuuugugacaugcugaggcuguuugacuuuaacaaacaagccauucaaagguuaaaagcugaggcacaaaugagcauucaguugauuaacaaagcagugaaugcuuugauaaaugaccaacuaauaaugaagaaccaucuacgggacaucauggggauuccauacuguaauuacagcaaguacugguaccuuaaccacacaacuacugggagaacaucacugcccaaauguuggcuuguaucgaaugguucauacuuaaacgagacccacuuuucugaugauauugaacaacaagcugacaacaugaucacugagauguuacaaaaagaguauauggaaaggcaggggaagacaccauugggucuaguugaccucuuuguguucagcacaaguuucuaucucauuagcaucuuccuucauuuagucaagauaccaacucauaggcauauuguaggcaagucgugucccaaaccucacagauugaaucacaugggcauaugcuccugcggacucuauggacagcccggugugccugugaaauggaagagauga

SEQ ID NO: 414 - RNA, 1476 nt, Artificial Sequence
  derived and/or modified CDS sequence (wt) from Lassa virus__AIT17196__GPC
augggacaaauagugacauucuuccaggaagugccccaugugauagaagaggugaugaacauuguucucauugcacugucuauacuagcagugcugaagggucuguacaaucuugcaacauguggccucguuggcuuggucacuuuucuccuguuguguggcaggucuuguacaacuagccuuuacaaagggguuuaugagcuucagacucuggaacuaaacauggaaacacucaauaugaccaugccucucuccuguacaaagaacaauagccaucauuacauaauggugggcaaugagacaggacuagaacugaccuugaccaacacgagcauuauaaaccauaaauuuugcaaucugucugaugcccacaaaaagaaccucuaugaccacgcucuuaugagcauuaucucaaccuuccacuuguccaucccuaacuucaaucaauaugaggcaaugagcugcgauuuuaaugggggaaagaucagugugcaguacaaccugagucacagcuaugccggggaugcagccaaccauuguggcacuguugcaaaugguguauuacagacuuucaugaggauggcuuggggugggagcuacauugcucuugacucaggccguggcaggugggacuguauuaugacuaguuaucaauaucugauaauccaaaauacaaccugggaagaucacugccaauucucgagaccaucucccaucgguuaucucgggcuccucucacaaaggaccagagauauuuauauuaguagaaggcuacuaggcacauucacauggacacugucagauucugaaggcaaggacacaccagggggauauugucuaaccagauggaugcuaauugaggcugaacuaaagugcuucgggaacacagcuguggcaaaauguaaugagaagcaugaugaggaguuuugugacaugcugaggcuguuugacuucaacaagcaagccauucaaagguugaaagcugaagcacaaaugaacauucaguugauuaacaaagcaguaaaugcuuugauaaaugaccaacuuauaaugaagaaccaucuacgggauaucauggggauuccauacuguaauuacaguaaguauugguaccucaaccacacaacuacugggaaaacaucacugcccagauguuggcuuguaucaaaugguucauaccugaacgagacccacuuuucugaugauauugaacaacaagcugacaacaugaucacugagauguuacagaaggaguauauggagaggcaggggaagacaccauugggucugguugaccucuuuguguucagcacaagcuucuaucucaucagcaucuuccuucaccuaguuaaaauaccaacucauaggcauauuguaggcaagccgugucccaaaccucacagguugaaucauaugggcauuuguuccuguggauucuauaaacagccuggugugccugugaaauggaagagauga

SEQ ID NO: 415 - RNA, 1476 nt, Artificial Sequence
  derived and/or modified CDS sequence (wt) from Lassa virus__AIT17204__GPC
augggacaaauagugacauucuuccaggaagugccccauguaauagaagaggugaugaacauuguucucauugcacuguccauacuagcagugcugaaaggucuguacaaccuugcaacauguggccucguuggcuuggucacuuuccucuuguuguguggcaggucuugcacaagcagccuuuauaaagggguuuaugagcuucagacucuggaacugaacauggaaacacucaauaugaccaugccucucuccugcacaaaaaacagcagucaucauuacauaagggugggcaaugagacaggacuagaacugaccuugaccaacacgagcauuauuaaucauaaauuuugcaaucugucugaugcccacaaaaagaaccucuaugaccacgcucucaugagcauuaucucuacuuuccacuuguccaucccuaacuucaaucaguaugaggcaaugagcugcgauuucaaugggggaaagauuagugugcaguacaaccuaagucacagcuacgccggggaugcagccaaccauuguggcacuguugcaaaugguguacuacagacuuucaugaggauggcuuggggugggagcuacauugcucuugacucaggccaugacaggugggacuguauuaugacuaguuaucaauaccugauaauucaaaauacaaccugggaagaucacugccaguucucgagaccaucuccuaucgguuaucuugggcuccucucacaaaggaccagagauauuuacauuaguagaaggcuacuaggcacauucacauggacacugucagauucugaaggcaaggacacaccagggggauauugucugaccagauggaugcuaauugaggcugaacuaaagugcuucgggaacacagcuguggcaaaauguaaugagaagcaugaugaagaauuuugugacaugcugaggcuguuugacuucaacaagcaggccauucaaagguugaaggccgaagcacaaaugagcauucaguugaucaacaaagcaguaaaugcuuugauaaaugaccaacuuauaaugaagaaccaucugcgggacaucauggggauuccauacuguaauuacagcaaguauugguaccucaaccacacaauuacugggaaaacaucacugcccaaauguuggcuuguaucaaaugguucauacuugaacaagacccacuuuucugaugacauugaacaacaagcugacaacaugaucacugagauguuacagaaggaguauauggagaggcaggggaagacaccauugggucuaguugaccuuuuuguguucagcacaaguuuuuaucucauuagcaucuuccuucaccuaaucaagauaccaacucauaggcacauuguaggcaaaccgugucccaaaccucacagguugaaucauaugggcaucuguuccuguggacucuacaaacagccuggugugccugugaaauggaagagauga

SEQ ID NO: 416 - RNA, 1476 nt, Artificial Sequence
  derived and/or modified CDS sequence (wt) from Lassa virus__AIT17208__GPC
augggacagauagugacauucuuccaggaagugccucauguaauagaagaggugaugaacauuguucucauugcacuguccauacuggcagugcugaaaggucuguacaauuuugcaacauguggccucauugguuuggucacuuuccuccuguuguguggcaggucuugcacaacuagucuuuauaaagggguuuaugagcuucagacucuggaacuaaauauggagacacucaauaugaccaugccucucuccugcacaaagaacaacagucaucauuacauaaugguggguaaugagacaggacuggaacugaccuugaccaacacaagcaucauuaaucauaaauuuugcaaucugucugaugcccacaaaaagaaccucuaugaccaugcccuuaugagcauaauuucaacuuuccacuuguccauccccaacuucaaucaguaugaggcaaugagcugcgacuucaaugggggaaagauuagugugcaguacaaccugagucacagcuaugcuggggaugcggccaaccacuguggcacuguugcaaauggugucuuacagacuuucaugaggauggcuuggggugggaguuacauugcucuugacucaggccguggccagugggacuguauuaugacuaguuaucaauaucugauaauccaaaauacgaccugggaagaucacugccaauucucaagaccaucacccaucgguuaucucgggcuccucucacagaggaccagagauauuuauauuaguagaagacuacuaggcacauuuacauggacacugucagauucugaagguaaggacacaccagggggauauugucugaccagguggaugcuaauugaagcugaauuaaaaugcuucggaaacacagcuguagcaaaauguaaugagaagcaugaugaggaauuuugugacaugcuaaggcuguuugacuucaacaaacaggcuauucaaaggcugaaagcugaagcacaaaugaguauucaguugaucaacaaggcaguaaaugcuuugauaaaugaccaacuuauaaugaagaaucaucuccgggacaucauggggauuccauacuguaauuacagcaaguauugguaccucaaccacacaacuacugggaaaacaucacugcccaaauguuggcuuguaucaaaugguucauacuugaacgagacccacuuuucugaugauauugaacaacaagcugacaacaugaucacugagauguugcagaaggaguacauggagaggcaggggaagacaccauugggccugguugaccucuuuguguucagcacaaguuucuaucucauuagcaucuuccuucaccuaguuaaaauaccaacucauaggcauauuguaggcaagucaugucccaaaccucacagauugaaucauaugggcauauguucuuguggacucuauaaacaacccggugugccugugaaauggaagagauga

SEQ ID NO: 417 - RNA, 1476 nt, Artificial Sequence
  derived and/or modified CDS sequence (wt) from Lassa virus__AIT17210__GPC
augggacaaauagugacauucuuccaggaggugccccauguaauagaagaggugaugaacauuguucucauugcacugucuauacuagcagugcugaaagguuuauacaaucuugcaacauguggccucguuggccuggucacuuuccuccuguuguguggaaggucuugcacaaccagccuuuacaaagggguuuaugagcuucagacucuggaacuaaacauggaaacacucaauaugaccaugccucucuccugcacaaagaacaacagucaucauuacauaauggugggcaaugagacaggauuagagcugaccuugaccaacacgagcauuauuaaccauaaauuuugcaaucugucugaugcccacaaaaagaaccucuaugaccacgcucuuaugagcaucaucucaacuuuccacuuguccaucccuaacuucaaucaguaugaggcaaugagcugcgauuucaaugggggaaagaucagugugcaguacaaccugagccacagcuaugccggggaugcagccaaccauuguggcacuguugcaaaugguguguugcagaccuucaugaggauggcuuggggugggagcuacauugcucuugacucaggccgugacaggugggauuguaucaugacuaguuaucaauaucuaauaauccagaauacaaccugggaagaucacugucaauucucgagaccauccccuaucgguuaucucggacuccucucacaaaggaccagagauauuuauauuaguagaaggcugcugggcacauucacauggacacugucagauucugaaggcaaggacacaccagggggauauugucugaccagauggaugcuaauugaggcugaacuaaagugcuuugggaacacagcuguggcaaaauguaaugagaagcaugaugaggaauuuugugacaugcugaggcuguuugacuucaacaaacaagccauucaaagguugaaagcugaagcacaaaugagcauucaguugaucaacaaagcaguaaaugcuuuaauaaaugaccaacuuauaaugaagaaccaucuacgggacaucauggggauuccauacugcaauuacagcaaguauugguaccucaaccacacaacuacugggaaaacaucacugcccaaauguuggcuuguaucaaaugguucauaccugaaugagacccacuuuucugaugauauugaacaacaagcugacaacaugaucacugaaauguuacagaaggaguauauggagaggcaggggaagacaccauugggucuaguugaccucuuuguguuuagcacaaguuucuaucucaucagcaucuuccuucgccuagucaaaauaccaacucacaggcauauugugggcaagccgugucccaaaccucacagguugaaucauaugggcauuuguucuuguggacucuacaaacagccuggcgugccugugaaauggaagagauga

SEQ ID NO: 418 - RNA, 1476 nt, Artificial Sequence
  derived and/or modified CDS sequence (wt) from Lassa virus__AIT17212__GPC
augggacaaauagugacuuucuuccaggaaguaccccaugugauagaagaggugaugaacauuguucucauugcacugucuauacuagcagugcugaagggucuguacaaucuugcaacauguggccucguuggcuugguuacuuuucuccuguuguguggcaggucuuguacgacuagccuuuacaaagggguuuaugagcuucagacucuggaacuaaacauggaaacacucaauaugaccaugccucucuccuguacaaagaacaauagccaucauuacauaauggugggcaaugagacaggacuagaacugaccuugaccaauacgagcauuauaaaccauaaauuuugcaaucugucugaugcccacagaaagaaccucuaugaccacgcucuuaugagcauuaucucaaccuuccacuuguccaucccuaacuucaaucaguaugaggcaaugagcugcgauuuuaaugggggaaagaucagugugcaguacaaccugagucacagcuaugccggggaugcagccaaccauuguggcacuguugcaaaugguguauuacagacuuucaugaggauggcuuggggugggagcuacauugcucuugacucaggccgugguaagugggacuguauuaugacuaguuaucaauaucugauaauccaaaauacaaccugggaagaucacugccaauucucgagaccaucucccaucgguuaccucgggcuccucucacaaaggaccagagauauuuauauuaguagaaggcuacuaggcacauucacauggacacugucagauucugaaggcaaggacacaccagggggauauugucuaaccagauggaugcuaauugaggcugaacuaaagugcuucgggaacacagcuguggcaaaauguaaugagaagcaugaugaggaauuuugugacaugcugaggcuguuugacuucaacaagcaagccauucaaagguugaaagcugaagcacaaaugagcauucaguugaucaacaaagcaguaaaugcuuugauaaaugaccaacuuauaaugaagaaccaucuacgggauaucauggggauuccauacuguaauuacaguaaguauugguaccucaaccacacaacuacugggaaaacaucacugcccagaugcuggcuuguaucaaaugguucauaucugaacgagacccacuuuucugaugauauugaacaacaagcugacaacaugaucacugagauguuacagaaggaguacauggagaggcaggggaagacaccauugggucugguugaccucuuuguguucagcacaagcuucuaucucaucagcaucuuccuucaccuaguuaaaauaccaacucauaggcauauuguaggcaagccgugucccaaaccucacagguugaaucauaugggcauuuguuccuguggacucuauaaacagccuggugugccugugaaauggaagagauga

SEQ ID NO: 419 - RNA, 1476 nt, Artificial Sequence
  derived and/or modified CDS sequence (wt) from Lassa virus__AIT17216__GPC
augggacagauagugacauucuuccaggaaguaccucaugugauagaagaggugaugaacauuguccucauugcacugucuauacuagcagugcugaaaggucuguacaauuuugcaacauguggccucguugguuugguuaccuuccuccuguuguguggcaggucuugcacaaccagucuuuacaaaggggucuaugagcuucagacucuggaauuaaacauggagacacucaauaugaccaugccccucuccuguacaaagaacaacagucaucauuauauuaugguggguaaugagacaggucuagagcugaccuugaccaacacgagcaucauuaaucauaaauuuugcaaucugucugaugcccacaaaaagaaccucuaugaucacgcucuuaugagcauaauuucaacuuuccaucuguccauucccaacuucaaucaguaugaggcaaugagcugugauuucaaugggggaaagauuagugugcaguacaaccugagucacaguuaugcuggggaugcggccaaccauuguggcacuguugcaaaugguguccuacagaccuucaugaggauggcuugggguggaagcuacauugcucuugacucaggccauggcaggugggacugcauuaugacuaguuaucaguaccugauaauccaaaauacaaccugggaagaucacugccaguucucaagaccaucucccaucggcuaucucggacuccucucacaaaggaccagagauauuuauauuaguagaagacuacuaggcacauucacauggacacugucagauucugaagguaaggacacaccagggggauauuguuugaccagauggaugcuaauugaagcugaacuaaagugcuucgggaacacagcuguggcaaaauguaaugagaagcaugaugaggaauuuugugacaugcugaggcuguuugacuucaacaaacaagccauucaaagauugaaagcugaagcacaaaugagcauucaauugaucaacaaggcaguaaaugccuugauaaaugaccagcuuauaaugaagaaccaucuacgagacauaaugggaauuccauacuguaauuacagcaaguauugguaccucaaccacacaaccacugggaaaacaucacugccuaaauguuggcuuguauccaaugguucauacuugaaugagacccacuuuucugaugauauugaacaacaagcugacaacaugaucacugagauguuacagaaagaguacauggagaggcaggggaagacaccauugggccuagucgaccucuuuguguucagcacaaguuucuaucucauuagcaucuuucuucaccuagucaaaauaccaacucauagacauauuguaggcaagccgugucccaaaccucacagauugaacuacaugggcauauguuccuguggacucuacaaacagcccggugugccugugagauggaagagauga

SEQ ID NO: 420 - RNA, 1476 nt, Artificial Sequence
  derived and/or modified CDS sequence (wt) from Lassa virus__AIT17224__GPC
auggggcaaauaguaacauuuuuccaggaaguuccucaugugauagaggaagugaugaacauuguacucaucgcauugucuauacuagcagugcuaaaaggacuguacaauguugcaacauguggccuuauuggcuuggucaccuuccuccuguugugcgguagaucuugcacaaccacucucuacaaaggagucuaugagcuucaggcucuggaauuaaacauggagacacucaauaugaccaugccucucuccugcacaaagaacaacagucaccauuauauaaggguaggcaaugacacaggacuugaacugacccuaaccaacacaagcauuauccaacacaaauuuuguaaucugucugaugcucacaaaaagaaccucuaugaccacacucucaugagcauaauuucaacuuuccacuuguccauccccaauuucaaucaguaugaggcuaugagcugugacuucaauggggggaagauuagugugcaauacaacuuaagucacagcuaugcuggggaugcagccagccauugugggacaguugcaaaugguguucugcaaacuuucaugagaauggcuuggggugggagcuauauugcucuugacucuggucguggcaauugggacuguaucaugacuaguuaccaauaucugauaauucagaauacaaccugggaggaucauugccaauucucaagaccaucccccaucgguuaccuugggcuccucucacaaaggaccagagauauuuacauuaguagaaggcuacuggguacauucacauggacauugucagacuccgaaggcagagacacaccaggaggguacugucugaccagauggauguuaauugaggcugaacuaaaaugcuuugguaacacagcuguagcaaaaugcaaugaaaagcaugaugaggaauucugugauaugcugaggcuguuugacuucaacaaacaggccauccaaagauugaaaacugaagcacaaaugagcauccaguugaucaacaaagcagugaaugcuuugauaaaugaccaacuaaucaugaagaaccauuugcgggacaucauggggauuccauacugcaauuacaguaaguacugguaccuuaacaacacaaucacugggaagucaucauugccuaaaugcuggcuuguguccaacgguucauaucuaaaugagacccauuucucugaugacauugagcaagaagccgacaauaugaucacugagauguugcaaaaagaguacauggaaaggcagggaaagacaccacugggcuugguugaccucuuuguuuuuaguacaaguuucuaucuuauuagcaucuuccuccaccuagucaaaauaccaacccauaggcauauuguagguaaaccgugucccaaaccucacaggcuaaaccacaugggaguaugcucuuguggacucuacaaacaacccggugugccuguaagauggaagagauga

SEQ ID NO: 421 - RNA, 1476 nt, Artificial Sequence
  derived and/or modified CDS sequence (wt) from Lassa virus__AIT17228__GPC
augggacagauagugacauucuuccaggaagugccucauguaauagaagaggugaugaacauuguacucauugcacugucuauacuagcagugcugaagggucuguacaauuuugcaacauguggccuuguuggucugcuuacuuuccucuuguuauguggcaggucuugcacaaccagucuuuacaaagggguuuaugagcuucagacucuggaacuaaacauggagacacucaauaugaccaugccucucuccugcacaaagaacaacagccaucauuauauaaugguggguaaugagacaggacuagaauugacuuugaccaacacgagcauuauugaucauaaauuuugcaaucugucugaugcccacaaaaagaaccuuuaugaccacgcucuuaugagcauaaucucaacuuuccauuuguccauucccaacuucaaucaguaugaggcaaugagcugugauuuuaauggaggaaagauuagugugcaguacaaucugagucacagcuaugcuggggaugcggccaaccauuguggcacuguugcaaauggugucuuacagacuuucaugaggauggccuggggugggagcuauauugcucuugacucaggccguggcggaugggacugcauuaugacuaguuaucaguaucugauaauccaaaacacaaccugggaagaucacugccaguucucaagaccaucucccaucgguuaucuugggcuccucucacaaagaaccagagauauuuacauuaguagaagguuacuaggcacauucacauggacacuaucagauucugaaggcaaggacacaccagggggauauuguuugaccagauggaugcuaauugaagcugaacuaaaaugcuucgggaacacagcuguagcaaaauguaaugagaagcaugaugaggaauuuugugacaugcugaggcuguuugacuucaacaaacaagccauucaaagguugaaagcugaagcacaaaugagcauucaauugaucaacaaggcaguaaaugcucugauaaaugaccaacucauaaugaagaaccauuuacgggacaucaugggaauuccauacuguaauuacagcaaguauugguaccucaaccauacaaccacugggaaaacaucacugccaaaauguuggcuugugucaaaugguucauacuuaaacgagacccacuuuucugaugauauugagcaacaagcugacaacaugauuacugagaugcugcagaaggaguauauggaaaggcagggaaagacaccauugggucuaguugaccucuuuguguucagcacaaguuucuaucucauuagcaucuuccuucaccuggucaaaauaccaacucauagacauauuguaggcaagucgugucccaaaccucacagauugaaucacaugggcauauguuccuguggacucuacaaacagcccggugugccuguaaaguggaagagauga

SEQ ID NO: 422 - RNA, 1476 nt, Artificial Sequence
  derived and/or modified CDS sequence (wt) from Lassa virus__AIT17232__GPC
augggacagauagugacauucuuccaggaagugccucauguaauagaagaggugaugaacauuguccucauugcgcugucuauauuagcagugcugaaaggucuauacaacuuugcaacauguggccucguugguuugguuacuuuccuccuguuguguggcaggucuugcacaaccagucuuuauaaaggggucuaugagcuucagacucuggaguuaaacauggagacacucaauaugaccaugccucucuccugcacaaagaauaacagucaucauuauauaaggguggguaaugagacaggacuagaacugaccuugaccaacacaaguauuauuaaucauaaauuuugcaaucugucugaugcccacaaaaagaaccucuaugaccacgcucuuaugagcauaauuucaacuuuccacuuguccauccccaauuucaaucaguaugaggcaaugagcugcgauuuuaaugagggaaagaucagugugcaguacaaccugagucacagcuaugcuggggaugcugccaaccauuguggcacuguugcaaauggugucuuacagacuuucaugaggauggcuuggggugggagcuacauugcccuugacucaggccguggcaagugggacuguauuaugacuaguuaucaauaucugauaauucagaauacaaccugggaagaucacugccaauucucaagaccaucuccuaucgguuaccuugggcuccucucacagaggaccagagauauuuauaucaguagaagacugcugggcacauucacauggacacugucagauucugaaggcaaggacacaccagggggauauugucugaccagauggaugcugauugaagcugaauugaaaugcuucgggaacacagcuguagcaaaauguaaugagaagcaugaugaggaauuuugugacauguugagguuguuugacuucaacaaacaagccauugaaagguugaaagcugaagcacaaaugagcauucaguugaucaacaaggcaguaaaugccuugauaaaugaucaacuuauaaugaagaaccaucuacgggacaucaugggaauuccauacuguaauuacagcaaauauugguaccucaaccacacaacuacugggaaaacaucacugccuaaauguuggcuuguaucaaaugggucauacuugaacgagacccacuuuucugaugauauugaacaacaagcugacaacaugaucacugagauguuacagaaggaguauauggagaggcaagggaagacaccauugggccuaguugaccucuuuguguucagcacaaguuucuaucucaucaguauuuuccuucaccuagucaagauaccaacccauaggcauauuguaggcaagucguguccuaaaccucacagauugaaucacaugggcauauguuccuguggacucuauaaacaacccggugugccugugaaguggaaaagauga

SEQ ID NO: 423 - RNA, 1476 nt, Artificial Sequence
  derived and/or modified CDS sequence (wt) from Lassa virus__AIT17236__GPC
augggacagauagugacauucuuccaagaagugccucaugugauagaagaggugaugaacauuguucucauugcgcugucuauauuagcagugcugaaaggucuauacaacuuugcaacauguggccucguugguuugguuacuuuccuccuguuguguggcaggucuugcacaaccagucuuuauaaaggagucuaugagcuucagacucuggaguuaaacauggagacacucaauaugaccaugccucucuccugcacaaagaauaacagucaucauuauauaaugguagguaaugagacaggacuagaacugaccuugaccaacacaaguauuauuaaucauaaauuuugcaaucugucugaugcccacaaaaagaaccucuaugaccacgcucuuaugagcauaauuucaacuuuccacuuguccauccccaacuucaaucaauaugaagcaaugagcugugauuuuaaugggggaaggauuagugugcaguacaaccugagucacagcuaugcuggggaagcugccaaccauuguggcacuguugcaaauggugucuuacagacuuucaugaggauggcuuggggugggagcuacauugcucuugacucaggccguggcaagugggacuguauuaugacuaguuaucaauaucugauaauccaaaauacaaccugggaagaucacugccaauucucaagaccaucuccuaucgguuaucuugggcuucucucacaacggaccagagauauuuacaucaguagaagacuacuaggcacauucacauggacacugucagauucugaaggcaaggacacaccagggggauauugucugaccagauggaugcugauugaagcugaauuaaaaugcuucgggaacacagcuguagcaaaauguaaugagaagcaugaugaggaauuuugugacauguugaggcuguuugacuucaacaaacaagccauucaaagguugaaagcugaagcacaaaugagcauucaguugaucaacaaggcaguaaaugccuugauaaaugaucaacuuauaaugaagaaccaucuacgggacaucaugggaauuccauacuguaauuacagcagauauugguaccucaaccacacaacuacugggaaaacaucacugccuaaguguuggcuugucucaaaugggucauacuugaacgagacccacuuuucugaugauauugaacaacaagcugacaacaugaucacugagauguuacagaaggaguauauggagagacaggggaagacaccauugggccuaguugaccucuuuguguucagcacaaguuucuaucucaucagcaucuuccuucaccuagucaaaauaccaacucauaggcauauuguaggcaagucguguccuaaaccucacagauugaaucacaugggcauauguuccuguggacucuacaaacagcccggugugccugugaaauggaaaagauga

SEQ ID NO: 424 - RNA, 1476 nt, Artificial Sequence
  derived and/or modified CDS sequence (wt) from Lassa virus__AIT17240__GPC
augggacagauagugacauucuuccaggaagugccucauguaauagaagaggugaugaacauuguucucauugcacuguccauacuggcagugcugaagggucuguacaaucuugcaacguguggccuuguuggguuaguuacuuuccucuuguuguguggcaggucuugcacaaccagucuuuauaaaggguuuuaugagcuucagacucuggaacuaaauauggaaacacucaauaugaccaugccucuuuccugcacaaagaacaacagucaucauuacauaaggguggguaaugagacaggacuggaacugaccuuaaccaauacgagcauuauugaucauaaauuuuguaaucugucugaugcccacaaaaagaaccucuaugaccaugcccucaugaguauaauaucaacuuuccacuuguccauccccaacuucaaucaguaugaggcaaugagcugcgauuuuaaugggggaaagauuagugugcaguacaaccugagucacagcuaugcuggggaugcggccaaccacuguggcacuguugcaaauggugucuuacagacuuucaugaggauggcuuggggugggaguuacauugcucuugacucaggccguggacggugggacuguauuaugacuaguuaucaauaucugauaauccaaaauacaaccugggaagaucacugccaauucucaagaccaucacccaucgguuaucucgggcuccuuucacaaaagaccagagacauuuauauuaguagaagacugcugggcacauucacauggacacugucagauucagaaggcaaggacacaccagggggauauugucugaccagauggaugcugauugaagcugaauuaaaaugcuucggaaacacagcuguagcaaaauguaaugagaagcaugaugaggaauuuugugacaugcugaggcuguuugacuucaacaagcaagccauucagaggcugaaagcugaagcacaaaugagcauucaguugaucaacaaggcaguaaaugcuuugauaaaugaccaacuuauaaugaagaaccaucuacgggacaucauggggauuccauacuguaauuacagcaaguauugguaccucaaccacacaacuacugggaaaacaucacuacccaaauguuggcuuguaucaaaugguucauacuugaacgagacucacuuuucugaugauauugaacaacaagcugacaacaugaucacugaaauguugcagaaggaguauauggagagacaggggaagacaccauugggucuaguugaccucuuuguguucagcacaaguuucuaucucauuagcaucuuccuucaccuagucaaaauaccaacucauaggcauauuguaggcaagucauguccuaaaccucacagauugaaucauaugggcauauguuccuguggacucuauaaacagcccggugugccugugaaauggaagagauga

SEQ ID NO: 425 - RNA, 1476 nt, Artificial Sequence
  derived and/or modified CDS sequence (wt) from Lassa virus__AIT17244__GPC
augggacaaauaguuacauucuuccaggaagugccccauguaauagaagaggugaugaacauuguucucauugcacuguccauacuagcaguacugaaaggucuguacaaucuugcaacauguggccucguuggcuuggucacuuuccuccuguuguguggcaggucuugcacaaccaaccuuuauaaagggguuuaugagcuucagacucuggaacugaacauggaaacacucaauaugaccaugccucucuccugcacaaaaaacagcagucaucauuacauaagggugggcaaugagacaggacuagaacugaccuugaccaacacgagcauuaucgaucauaaauuuugcaaucugucugaugcccacaaaaagaaccucuaugaccacgcucuuaugagcauuaucuccacuuuccacuuguccaucccuaacuucaaucaguaugaggcaaugagcugcgauuucaauggggggaagauuagugugcaguacaaccugagucauagcuacgucggggaugcagccgaccauuguggcacuguugcaaaugguguacuacagacuuucaugaggauggcuuggggugggagcuacauugcucuugacucaggccguggcaagugggacuguauuauaacuaguuaucaauaccugauaauucaaaauacaaccugggaagaucacugccaguucucgagaccaucucccaucgguuaucuugggcuccucucacaaaggaccagagauauuuacauuaguagaaggcuacuaggcacauucacauggacacugucagauucugaaggcaaggacacaccagggggauauugucugaccagauggaugcuaauugaggcugaacuaaagugcuucgggaacacagcuguggcaaaauguaaugagaagcaugaugaagaauuuugugacaugcugaggcuguuugacuucaacaagcaggccauucaaagguugaaggcugaagcacaaaugagcauucaguugaucaacaaagcaguaaaugcuuugauaaaugaccaacuuauaaugaagaaccaucuacgggacaucauggggauuccauacuguaauuacagcaaguauugguaccucaaucacacaauuacugggaaaacaucacugcccagauguuggcuuguaucaaaugguucauacuugaacgagacccgcuuuucugaugacauugaacaacaagcugacaacaugaucacugagauguuacagaaggaguauauggagaggcaggggaagacaccauugggucuaguugaccucuuuguguucagcacaaguuucuaucucauuagcaucuuccuucaccuagucaagauaccaacucauaggcauauuguaggcaaaccgugucccaaaccucacagguugaaucauaugggcaucuguuccuguggacucuacaaacagccuggugugccugugaaauggaagagauga

SEQ ID NO: 426 - RNA, 1476 nt, Artificial Sequence
  derived and/or modified CDS sequence (wt) from Lassa virus__AIT17246__GPC
augggacaaauagugacuuucuuucaggaagugccucaugugauagaggaggugaugaacauugugcucaucgcauugucucuacuggcaguguugaaaggucuguacaaugucgcaacauguggccucauuggucugaucaccuuccuuuuacugugugguagauccugcacaaccaaucuuuacaaaggagucuaugagcuucagacucuggaacuaaacauggagacacucaauaugaccaugccucucucuugcacaaagaacaguagccaccacuauauaaugguggguaaugagacgggacuggaauugaccuugaccaacacaagcaucaucaaccacaaguuuuguaaucugucugaugcucacaaaaagaaucucuaugaucacacccuuaugagcauaauuucgacuuuucaccuguccauucccaacuucaaucaguaugaagcaaugagcugugacuucaacggagggaaaauuagugugcaguacaacuuaagccacagcuaugcuguggaugcagccaaccauuguggcacaguugcaaaugguauccuacagacuuucaugaggauggccuggggugggaguuauauugcccuugauucaggccguggcaauugggauuguauuaugacuaguuaccaauaucuaauaauucagaauacaaccugggaagaucacugccaguucucaagaccaucucccaucggcuaucuugggcuccucucacaaaggaccagagacauuuauauuaguagaagacuacugggcacauucacauggacacuaucagauucugaaggcaaugacacaccagggggauacugucugaccagguggauguuaauugaggcugagcugaaaugcuucgguaauacagcuguggccaaaugcaaugaaaaacaugaugaagaauucugugacaugcugagacuguuugacuuuaacaaacaagccauucaaagauuaaaggcugaggcacaaaugaguauccaguugaucaacaaggcagugaaugcucugauuaaugaccaauuaauaaugaaaaaccaucuacgggacaucauggggauuccauacuguaacuauaguaaguauugguaucucaaccacacaaccacuggaaaaacaucguugcccaaaugcuggcuuguaucuaaugguucauaucuaaacgagacccacuuuucugaugacauugaacagcaagccgacaacaugauaacugagaugcuacaaaaagaguacauggagagacaggggaagacaccauuaggucugguugaucucuuuguguucagcacaaguuucuaccucauuagcauuuuccuucaccuagucaaaauaccaacacauaggcacauuguuggcaaaccguguccgaaaccucacaggcugaaucacaugggcauauguucuuguggacucuacaaacaaccugguguaccugugagauggaagagauaa

SEQ ID NO: 427 - RNA, 1476 nt, Artificial Sequence
  derived and/or modified CDS sequence (wt) from Lassa virus__AIT17250__GPC
augggacaaauagugacuuucuuccaggaagugccucaugugauagaggaggugaugaacauugugcucaucgcauugucucuacuggcaguguugaaaggucuguacaauguugcaacauguggccucauuggucuggucaccuuccuuuuacugugugguagauccugcacaaccaaucuuuacaaaggagucuaugagcuucagacucuggaacuaaacauggagacacucaauaugaccaugccucucucuugcacaaagaacaacagccaccacuauauaaugguggguaaugagacgggacuggaauugaccuugaccaacacaagcaucaucaaccacaaguuuuguaaucugucugaugcucacaaaaagaaucucuaugaucacacccuuaugagcauaauuucgacuuuucaccuguccauucccaacuucaaucaguaugaagcaaugagcugugacuucaauggagggaaaauuagugugcaguacaacuuaagccacagcuaugcuguggaugcagccaaccauuguggcacaguugcaaaugguguccuacagacuuucaugaggauggccuggggugggagcuauauugcccuugauucaggccguggcaauugggauugcauuaugacuaguuaccaauaucuaauaauucagaauacaaccugggaagaucacugccaguucucaagaccaucucccaucggcuaucuugggcuccucucacaaaggaccagagacauuuauauuaguagaagacuacugggcacauucacauggacacuaucagauucugaaggcaaugacacaccagggggauacugucugaccagguggauguuaauugaggcugagcugaaaugcuucgguaauacagcuguagccaaaugcaaugaaaaacaugaugaagaauucugugacaugcugagacuguuugacuuuaacaaacaagccauucaaagauuaaaggcugaggcacaaaugaguauccaguugaucaacaaggcagugaaugcucugauuaaugaccaauuaauaaugaaaaaccaucuacgagacaucauggggauuccauacuguaacuauaguaaguauugguaucucaaccacacaaccacuggaaaaacaucguugcccaaaugcuggcuuguaucuaaugguucauaucuaaacgagacccacuuuucugaugacauugaacagcaagccgacaacaugauaacugagaugcuacaaaaagaguacauggagagacaggggaagacaccauuaggucugguugaucucuuuguguucagcacaaguuucuaccucauuagcauuuuccuucaccuagucaaaauaccaacacauaggcacauuguuggcaaaccguguccgaaaccucacaggcugaaucacaugggcauauguuccuguggacucuacaaacaaccugguguaccugugagauggaagagauaa

SEQ ID NO: 428 - RNA, 1476 nt, Artificial Sequence
  derived and/or modified CDS sequence (wt) from Lassa virus__AIT17254__GPC
auggggcaaauagugacauucuuccaggaaguaccucaugugauagaagaggugaugaacauuguucucauugcacugucuauacuagcagugcugaaagguuuguacaauuuugcaacaugugguaucguugguuuggucacuuuccucuuguuguguggcaggucuugcacaaccagccucuacaaagggguuuaugaacuucagacgcuggaacuaaacauggagacacucaauaugaccaugccucucuccugcacaaagaacaacagucaccauuacauaauggugggcaaugagacgggacuagaacugaccuugaccaacacgagcauuauaaaucauaaauuuugcaaucugucugaugcccacaaaaagaaccucuaugaccacgcucuuaugagcauaauuucaacuuuccacuuguccauccccaacuucaaucaguaugaggcaaugagcugugauuucaaugggggaaaaaucagugugcaguauaaccugagucauagcuaugcuggggaugcagccaaucauuguggcacagucgcaaauggugucuuacaaacuuucaugaggauggccuggggugggagcuacauugcucuugacucaggccgugacaggugggacuguauuaugacuaguuaucaauaucugauaauccaaaacacaaccugggaagaucacugccaguucucaagaccaucucccaucggcuaucucgggcuccucucacaaagaaccagagauauuuacauuagcagaagauugcugggcacauucacauggacacugucagacucugagggcaagaacacaccaggaggauauugucugaccagauggaugcuaauugaggcugaacugaaaugcuuugggaacacagcuguggcaaaaugcaaugagaagcaugaugaggaauuuugugacaugcugaggcuguuugacuucaacaaacaagccauucaaagguugaaagccgaagcacaaaugagcaucagcuugaucaacaaagccguaaaugcuuugauaaaugaccaauuaauaaugaagaaccaucuacgggacaucaugggaauuccauacuguaauuacagcaaguauugguaccucaaccacacaacuacugggaaaacaucacuacccagauguuggcuuguaucaaaugguucauacuugaacgagacccacuucucugaugauauugaacaacaagcugacaacaugaucacugagauguuacagaaggaguauauggauaggcaggggaagacaccauugggucuaguugaccucuuuguauuuaguacaaguuucuaucucauuagcaucuuccuucaccuggucaaaauaccaacucauagacauauuguaggcaagacaugccccaaaccucacagguugaaucacaugggcauauguuccugcggacucuauaaacagcccggugugccuguaaaauggaagagauga

SEQ ID NO: 429 - RNA, 1476 nt, Artificial Sequence
  derived and/or modified CDS sequence (wt) from Lassa virus__AIT17258__GPC
augggacaaauagugacauucuuccaggaaguaccccauguaauagaagaggugaugaacauuguucucauugcacugucuauacuagcaguguugaaaggucuguacaauauugcgacauguggccucguuggcuuggucacuuuccuccuguuguguggcaggucuuguacaacuagccuuuacaaagggguuuaugagcuucagacucuggaacuaaacauggaaacacucaauaugaccaugccucucuccugcacaaagaacaauagucaucauuacauaauggugggcaaugagacaggauuagaacugaccuugaccaacacgagcaucauuaaucauaaauuuugcaaucugucugaugcccacaaaaagaaccucuaugaccacgcucucaugagcauugucucaaccuuccacuuguccaucccuaacuucaaucaguaugaggcaaugagcugcgauuucaaugggggaaagauuagugugcaguacaaccugagucacagcuaugccguggaugcagccaaccauuguggcacuguugcaaaugguguauuacagacuuucaugaggauggcuuggggugggagcuacauugcucuugacucaggcagaggcgggugggacuguauaaugacuaguuaucaauaucugauaauccaaaauguaaccugggaagaucacugccaauucucgagaccaucucccaucgguuaccucgggcuccucucacaaagaaccagggauguuuauauuaguagaagguugcuaggcacauucacauggacacugucagauucugaaggcaaugacacaccagggggauauugucuaaccagauggaugcuaauugaagcugaacuaaagugcuuugggaacacagcuguggcaaaguguaaugagaagcaugaugaggaauuuugugacaugcugaggcuguuugacuucaacaaacaagccauucaaagguugaaagcugaagcacaaaugagcauucaguugaucaacaaagcaguaaaugcuuugauaaaugaccaacuuauaaugaagaaccauuuacgagacauuauggggauuccauacuguaauuacagcaaguauugguaccucaaccacacaacuacugggaaaacaucacugcccaaauguuggcuuguaucaaaugguucauaccugaacgagacccacuuuucugaugauauugaacaacaagcugacaacaugaucacugagauguuacagaaggaguauauggagaggcaggggaagacaccacugggucugguugaccucuuuguguucagcacaagcuucuaucucauuagcaucuuccuucaccuaguuaaaauaccaacucauaggcauauuguaggcaagccgugucccaaaccucacagguugaaucauaugggcauuuguuccuguggacucuauaaacagccuggugugccuguuaaauggaagagauga

SEQ ID NO: 430 - RNA, 1476 nt, Artificial Sequence
  derived and/or modified CDS sequence (wt) from Lassa virus__AIT17262__GPC
augggacaaauagugacauucuuccaggaggugccccaugugauagaagaggugaugaacauuguucucauugcacugucuauacuagcaguguugaagggucuguacaaucuugcaacauguggccuuguuggcuuggucacuuuccuccuguuguguggcaggucuuguacaacuagccuuuacaaagggguuuaugagcuucagacucuggaacuaaacauggaaacacucaauaugaccaugccucucuccugcacaaagaacaauagucaucauuacauaauggugggcaaugagacaggacuggaacugaccuugaccaacacgagcaucauuaaucauaaauuuugcaaucugucugaugcccacaaaaagaaucucuaugaccacgcucuuaugagcauuaucucaaccuuccacuuguccaucccuaacuucaaucaguaugaggcaaugagcugcgauuuuaaugggggaaagaucagugugcaguacaaccugagucacagcuaugccggggaugcagccacucacuguggcacugucgcaaaugguguauuacagacuuucaugaggauggcuuggggugggagcuacauugcucuugacucaggccguggcaagugggacuguaucaugacuaguuaucaauaucugauaauccaaaauacaaccugggaagaucacugccaauucucgagaccaucucccauugguuaucuugggcuccuuucacaaaggaccagagauauuuacauuaguagaaggcuacuaggcacauucacauggacacugucagauucugaaggcaaggacacaccagggggauauugucuaaccagauggaugcugauugaagcugaacuaaagugcuucgggaacacagcuguggcaaaauguaaugagaagcaugaugaggaauuuugugacaugcugagguuguuugacuuuaauaaacaagccauucaaagguugaaaacugaagcacaaaugagcauucaguugaucaacaaagcaguaaaugcuuugauaaaugaccaacuuauaaugaagaaccaucuacgggauaucauggggauuccauacuguaauuacagcaaguauugguaccucaaccacacaacuacugggaaaacaucacugcccagauguuggcuuguaucaaaugguucauaccugaacgagacccacuuuucugaugauaucgaacaacaagcugacaauaugaucacugagaugcuacagaaggaauauauggagaggcaggggaagacaccauugggucugguugaccucuuugucuucagcacaagcuucuaucucaucagcaucuuccuucaccuaguuaagauaccaacucauaggcauauuguaggcaagccgugucccaaaccucacaggcugaaucauaugggcauuuguuccuguggacucuacaaacagccuggugugccugugaaauggaagagauga

SEQ ID NO: 431 - RNA, 1476 nt, Artificial Sequence
  derived and/or modified CDS sequence (wt) from Lassa virus__AIT17266__GPC
augggacagauagugacauucuuccaggaagugccucauguaauagaagaggugaugaacauuguucucauugcacuguccauacuggcagugcugaaaggucuguacaaucuugcaacauguggccucguugguuuggucacuuuccuccuguugugugguaggucuugcacaaccagucuuuacaaagggguuuaugagcuucagacucuggaacuaaacauggagacacucaacaugaccaugccucucuccugcacaaagaacaacagucaucauuauauaaugguggguaaugagacaggacuagaacugaccuugaccaacacgagccuuauuaaucacaaauuuugcaaccugucugaugcccacaaaaagaaccucuaugaccacgcucuuaugagcauaaucucaacuuuccacuuguccauccccaacuucaaucaguaugaggcaaugagcugcgauuuuaaugggggaaagauuagugugcaguacaaccugagucacagcuaugccguggaugcagccaaccauuguggcacugucgcaaaugguguacuacagacuuucaugaggauggcuuggggugggagcuacauugcucuugacucaggccgugguggaugggacuguauuaugacuaguuaucaauaucugauaauccaaaauacaacuugggaagaucacugccaauucucgagaccaucuccuaucgguuaucucgggcuccucucacaaaggaccagagauauuuauaucaguagaagacuacuaggcacauucacauggacauugucagauucugaaggcaaggacacaccagggggauauuguuugaccagguggaugcugauugaggcugaacuaaaaugcuucgggaacacagcuguggcaaaauguaaugagaaacaugaugaggaauuuugugacaugcugaggcuguuugacuucaacaaacaagccauucaaaggcugaaagcugaagcacaaaugagcauucaguugaucaacaaagcaguaaaugcuuugauaaaugaucaacuuauaaugaagaaccaucuacgggauaucaugggaaucccauacuguaauuacagcaaguauugguaccucaaccacacaacuacugggagaacaucacugccuagauguuggcuuguaucaaaugguucauaccugaacgagacccacuuuucugaugauauugaacaacaagcugacaacaugaucacugagauguuacagaaggaguauauggaaaggcaggggaagacaccauugggccuaguugaucucuuuguguuuagcacaaguuucuaucucauuagcaucuuucuucaccuagucaaaauaccaacgcauaggcauauuguaggcaagucgugucccaaaccucacagacugaaucacaugggcauuuguuccugugggcuuuauaaacagccuggugugccuguaaaauggaagagauga

SEQ ID NO: 432 - RNA, 1476 nt, Artificial Sequence
  derived and/or modified CDS sequence (wt) from Lassa virus__AIT17270__GPC
augggacagauagugacauucuuccaggaagugccucauguaauagaagaggugaugaacauuguucucauugcgcugucuguacuagcagugcugaaaggucuguacaauuuugcaacauguggccucguugguuuggucacuuuccuccuguuguguggcaggucuugcucaacuaguguuuauaaagggguuuaugagcuucagacucuggaacuaaauauggagacacucaacaugaccaugccucucuccugcacaaagaacaacagucaucauuauauaaugguggguaaugagacaggacuagaacugaccuugaccaacacuagcaucaucaaucauaaauuuuguaaucugucugaugcccacaaaaagaaccucuacgaccaugcucuuaugagcauaaucucaacuuuucacuuguccauccccaauuucaaucaguaugaggcaaugagcugcgauuucaaugggggaaagauuagugugcaguacaaccugagucacagcuaugcuguggaugcggccaaccauuguggcacuguugcaaauggugucuuacagacuuucaugaggauggcuuggggugggagcuacauugcucuugacucaggccauggugggugggauugcauuaugacuaacuaucaauaucugauaauccagaauacaaccugggaggaucacugccaauucucaagaccaucucccaucgguuaucucgggcuccuuucacaaaggaccagagauauuuauauuaguagaagacuacuaggcacauucacauggacacugucagauucugagggcaaggacacaccagggggauauugucugaccagauggauguugauugaagcugaacuaaaauguuucgggaacacagcuguagcaaaauguaaugagaagcaugaugaggaauuuugugacaugcugaggcuguuugacuucaacaaacaagccauucaaagguugaaagcugaagcacaaaugagcauucaguugaucaacaaggcagugaaugcauugauaaaugaccaacuuauaaugaagaaccaucuacgggacaucaugggaauuccguacuguaauuauagcaaguauugguaccucaaccacaccacuacugggagaacaucacuacccaaauguuggcuugugucaaaugguucauacuugaacgagacucacuuuucugaugauauugaacaacaagcugacaacaugaucacugagauguuacaaagggaguauauggagaggcaggggaagacaccauugggucuaguugaccucuuuguguucagcacaaguuucuaucucauuagcaucuuccuucaccuggucaaaauaccaacucauaggcauauugugggcaagucgugccccaaaccucacagacugaaucacaugggcauauguuccuguggucucuauaaacagccaggugugccugugaaguggaagagauga

SEQ ID NO: 433 - RNA, 1476 nt, Artificial Sequence
  derived and/or modified CDS sequence (wt) from Lassa virus__AIT17274__GPC
augggacaaauagugacauuuuuccaggaagugccucaugugauagaggaggugaugaacauuguacucaucgcacugucuauacuugcagugcuaaaaggucuguacaauguugcaacauguggccuuacugguuugguugccuuucuuuuacugugugguagaucuuguacaaccacucuguacaaaggaguuuaugaacuucaggcccuggaauuaaacauggagacacucaauaugaccaugccucucuccugcacaaagaacaauagucaccacuacauaaggguaggcaaugagacaggacuagaacuaaccuugaccaauacaagcaucaucgagcauagguuuuguaacuuaucugaugcccacaaaaagaaccucuaugaucaugcucuuaugaguauaaucucaacuuuccacuuguccauucccaacuucaaucaguaugaagcaaugaguugugacuuuaauggggggaaaauuagugugcaauacaaccuaagucacagcuaugcuguagaugcagccaaccauuguggcacagucgcaaauggcguuuugcagacuuucaugaggauggccuggggugggaguuacauugcucuugauucaggccgcaaugggugggauuguaucaugaccaguuaucaauaccuaauuauucagaacacaacuugggaagaucacugccaauucucaagaccaucucccauugguuaccuugggcuccuuucacaaaggaccagagacauuuacaucaguaggagacugcuaggcacauucacauggacacugucggauucugaagguaaagauacaccagggggguacugucugaccagauggaugcuaauugaggcugagcugaaauguuucggcaacacagcuguagccaaauguaaugagaagcaugaugaagaauucugugacaugcugaggcuauuugacuucaacaaacaagcuauccaaagguuaaaggcugaagcacaaaugagcauucaguugaucaacaaggcugugaacgcuuuaauaaaugaucaacugauaaugaaaaaccaucugcgggauaucauggggauuccauacuguaacuacagcaaguacugguaucucaacaacacagccacugggaaaacaucacuaccuagaugcuggcuugugucaaaugguucauaccugaacgagacccacuucucugaugacauugaacaacaagcugacaacaugaucacugagauguugcagaaggaguacauggagaggcaggggaagacaccauugggccugguugaccucuuuguguuuagcacaaguuuuuaucuuaucaguaucuuccuucaccuagucaaaauaccaacucauagacacauuguaggcaaaccguguccuaaaccucacaggcugaaucauaugggcauaugcuccuguggacucuauaaacaacccggugcaccuguaagauggaagagauaa

SEQ ID NO: 434 - RNA, 1476 nt, Artificial Sequence
  derived and/or modified CDS sequence (wt) from Lassa virus__AIT17276__GPC
augggacagauagugacauucuuccaggaagugccucauguaauagaagaggugaugaacauuguccucauugcgcugucuauauuagcagugcugaaaggucuguacaacuuugcaacauguggccucguugguuugguuacuuuccuccuguuguguggcaggucuugcacaaccagucuuuauaaaggggucuaugagcuucagacucuggaguuaaacauggagacacucaauaugaccaugccucucuccugcacaaagaauaacagucaucauuauauaaugguagguaaugagacaggacuagaacugaccuugaccaacacaagcauuauuaaucauaaauuuugcaaucugucugaugcccacaaaaagaaccucuaugaccaugcccuuaugagcauaauuucaacuuuccacuuguccauccccaacuucaaucaguaugaagcaaugagcugugauuucaaugggggaaagauuagugugcaguacaaccugagucacagcuaugcuggggaugcugccaaccauuguggcacuguugcaaauggugucuuacagacuuucaugaggauggcuuggggugggagcuacauugcucuugacucaggccauggcaagugggacuguauuaugacuaguuaucaauaucugauaauccaaaauacaaccugggaagaucacugccaauucucaagaccaucuccuaucgguuaucuugggcuucucucacaaaggaccagagauauuuauaucaguagaagacuacuaggcacauucacauggacacugucagauucugaaggcaaggacacaccagggggauauugucugaccagauggaugcugauugaagcugaauuaaaaugcuucgggaacacagcuguagcaaaauguaaugagaagcaugaugaggaauuuugugacauguugaggcuguuugacuucaacaaacaagccauucaaagguugaaagcugaagcacaaaugagcauucaguugaucaacaaggcaguaaaugccuugauaaaugaucaacuuauaaugaagaaccaucuacgggacaucaugggaaucccauacuguaauuacagcaaauauugguaccucaaccacacaacuacugggaaaacaucacugccuaaauguuggcuugucucaaaugggucauacuugaacgagacccacuuuucugaugauauugaacaacaagcugacaacaugaucacugagauguuacagaaggaguauauggagaggcaggggaagacaccauugggccuaguugaccucuuuguguucagcacaaguuucuaucucaucagcaucuuccuucaccuagucaaaauaccaacucauaggcauauuguaggcaagucguguccuaaaccucacagauugaaucacaugggcauauguuccuguggacucuacaaacagcccggugugccugugagauggaaaagauga

SEQ ID NO: 435 - RNA, 1473 nt, Artificial Sequence
  derived and/or modified CDS sequence (wt) from Lassa virus__AIT17280__GPC
augggacaaauagugacauucuuccaggaagugccucauguaauagaagaggugaugaacauuguucucauugcacugucaauauuggcagugcuaaaaggucuguauaauuuugcuacauguggccucguugguuugguuacuuuccucuuacuguguggcaggucuugcacaaccagccuuuacaaaggaguuuaugagcuucagacucuagaacuaaacauggagacucucaauaugaccaugccccucucuugcacaaagaacaauagucaucauuacauaagggugggcaaugagacagggcuagaacugacuuuaaccaacacgagcauuauugaucauaaauuuugcaaucugucugaugcccacaaaaagaaccuuuaugaccacgcucuuaugagcauaaucucaacuuuccacuuguccaucccuaacuucaaucaguaugaggcaaugagcugugauuuuaaugggggaaagauuagugugcaguacaaccuaagucacagcuaugcuggggaugcagccaaccauuguggcacaguugcaaaugguguccugcagacuuucaugaggauggccugggguggaagcuacauugcucuugacucaggccaugaaugggacugcauuaugaccagcuaucaauaccugauaauccaaaauacaaccugggacaaucauugccaguucucaagaccaucucccaucgguuaucucggucuccuuucgcaaaggaccagagacauuuauauuaguagaagacugcuaggcacauucacauggacacugucagauucugaaggcaaggacacaccagggggguauugucugacuagauggaugcuaauugaggcugaacuaaaaugcuucgggaacacagcuguggcaaaaugcaaugagaaacaugacgaagaauucugugauaugcugaggcuguuugacuucaacaagcaggccauucaaagguuaaaagucgaagcacaaaugagcauucaguuaaucaacaaagcaguaaaugcucugauaaaugaucaacuaauaaugaagaaccauuuacgggauauuaugggaauuccauacuguaauuacagcaaguacugguaccucaaccacacaacuacugggaaaacaucacugcccaaauguuggcuuguaucaaauggaucauauuugaacgagacccacuuuuccgaugacauugagcaacaagcugacaauaugaucacugagauguugcagaaagaguauauggagagacaggggaaaacaccauugggccuaguugaccucuuuguguucagcacaaguuucuaucucauuagcaucuuccuucaccuagucaaaauaccaacucauaggcacauugugggcaagucauguccaaaaccucacagguugaaucacaugggcauauguuccugcggauucuauaaacagcccggugugccuguaaaauggaagagauga

SEQ ID NO: 436 - RNA, 1476 nt, Artificial Sequence
  derived and/or modified CDS sequence (wt) from Lassa virus__AIT17288__GPC
augggacaaauagugacauucuuccaggaagugccucauguaauugaagaggugaugaacauuguucucauugcacuguccauauuggcagugcugaaaggccuguacaauuuugcuacauguggccucguugguuugguuacuuuccucuuauuguguggcaggucuugcacaacuagucuuuacaaagggguuuaugaacuucagacucuggaacuaaacauggagacacucaauaugaccaugccucucucuugcacaaagaacaauagucaucauuacauaauggugggcaaugagacagggcuggaacuaaccuugaccaacacgagcauuauuaaucacaaguuuuguaaucugucugaugcccacaaaaagaaccucuaugaccacgcucuuaugaguauaaucucaacuuuccacuuguccauccccaacuuuaaucaguaugaggcaaugagcugugauuuuaauggaggaaagauuagugugcaguacaaccugagucacagcuaugcuguggaugcagccaaccauuguggcacaguugcaaauggugucuuacagacuuucaugaggauggccugggguggaggauacauugcucuugacucaggccguggcaauugggauugcauuaugaccagcuaucaauaucugauaauccaaaacacaaccugggaggaccacugccaauucucaagacccucucccaucgguuaucucggucuccuuucacaaaggaccagagauauuuauaucagcagaagacuacuaggcacauuuacauggacacugucagacucugaaggcaaggacacaccaggaggguauuguuugacuagauggaugcuaauugaggcugaacugaaauguuucgggaacacagcuguggcaaaaugcaaugagaaacaugaugaggaauuuugugauaugcugaggcuguuugacuucaacaaacaagccauucaaagguuaaaagcugaagcacaaaugagcauucaguugaucaacaaagcaguaaaugcuuugauaaaugaucaacugauaaugaagaaccaucuacgggacauuaugggaauuccauacuguaauuacagcaaauacugguaccucaaucacacaguuacugggaaaacaucacugccuaaauguuggcuuguaucaaaugguucauauuugaaugagacucacuuuucugaugacauugagcaacaagcugacaauaugaucacugagauguugcagaaagaguacauggagaggcaagggaaaacaccauugggucuaguugaccucuuuguguucagcacaaguuuuuaucucauuagcaucuuccuucauuuggucaaaauaccuacucauaggcauauugugggcaagucgugcccaaaaccucauagguugaaucacauggguauauguuccugcggacucuacaaacagcccggugugccuguaagauggaagagauga

SEQ ID NO: 437 - RNA, 1476 nt, Artificial Sequence
  derived and/or modified CDS sequence (wt) from Lassa virus__AIT17292__GPC
auggggcaaauaguaacauucuuccaagaagugccucaugugauagaggagguaaugaauauuguacucaucgcacugucgauaauggcaguacugaaagguuuguacaauauugcaacauguggccucgucgguuuaguuaccuuucucuugcugugugguagguccugcacaaccacccucuacaagggggucuaugagcugcagacccuggaacugaacauggaaacacucaacaugaccaugccucucucuugcacaaagaauaauagucaccacuauauuaugguggguaaugagacaggacuagaacugaccuuaaccaauacaagcauuaucaaccacaaauuuugcaaucugucugaugcucacaaaaagaaccucuaugaucaugcucuuaugagcauaaucucaacuuuccauuuauccauuccuaacuucaaucaguaugaggcaaugagcugugacuucaaugggggaaagaucagugugcaguacaaccugagucacagcuaugcuggagaugcagcuaaccauuguggcacaguugcaaaugguguccuucagacuuucaugaggauggcuugggguggaaguuauauugcucuugauucaggccacgguggaugggacuguauuaugaccaguuaucaguaucuaauaauucaaaauacaaccugggaagaucacugccaauucacaagaccaucucccaucgguuaucuugggcuccucucacaaagaaccagagauauuuauauuaguagaagacuacugggaacauucacauggacacugucagauucugaagggaaugacacaccagggggguauuguuugacuagauggaugcuaauugaagcugaguugaagugcuuuggcaauacagcuguugcaaaauguaaugaaaagcaugaugaagaguuuugugacaugcuaaggcuguuugauuuuaacaaacaggcuauccaaagacugagagcugaagcacaaaugaguauucaauuaaucaacaaagcagugaaugcccugauaaaugaucaacuaauaaugaaaaaccauuuacgggacauuaugggaauuccauacuguaacuacagcaaguauugguaucuuaaccacacaaccaccggaagaacaucauugccuagaugcuggcuuguaucuaaugguucauaccucaaugaaacucacuucucagaugacauugaacagcaggcugacaacaugauuacugagauguuacaaaaggaguacauggagagacaggggaaaacaccauuggguuugguugaucuuuuuguuuucagcacaaguuucuaucucauuagcaucuuucuucaccugaucaaaauaccaacucacaggcauauugugggcaaaccaugucccaaaccucacagguuaaaccacauggguguuugcuccuguggacucuauaagcaaccuggugugcccguaagguggaagagauga

SEQ ID NO: 438 - RNA, 1476 nt, Artificial Sequence
  derived and/or modified CDS sequence (wt) from Lassa virus__AIT17294__GPC
augggacaaauagugacauucuuccaggaagugccccaugugauagaagaggugaugaacauuguucucauugcacugucuauacuagcaguguugaagggucuguacaaucuugcaacauguggccucguuggcuuggucacuuuccuccuguuguguggcaggucuuguacaacuagccuuuacaaagggguuuaugagcuucagacucuggaacuaaacauggaaacacucaacaugaccaugccucucuccugcacaaagaacaauagucaucauuacauaauggugggcaaugagacaggacuagaacugaccuugaccaacacaagcauuauugaucauaaauuuugcaaucuaucugaugcccacaaaaagaaccucuaugaccacgcucuuaugagcauuaucucaaccuuccacuuguccaucccuaacuucaaucaguaugaggcaaugagcugcgauuuuaaugggggaaagaucagugugcaguacaaccugagucacagcuaugccggggaugcagccaaccauuguggcacugucgcaaaugguguauuacagacuuucaugaggauggcuuggggugggagcuacauugcucuugacucaggccguggcgggugggacuguauuaugacuaguuaucaauaucugauaauccaaaauacaacuugggaagaucacugccaauucucgagaccaucucccgucgguuaucucggacuccucucacaaaggaccagagauauuuacauuaguagaaggcuacuaggcacauucacauggacacugucagauucugaaggcaaggacacaccagggggauauugucuaaccagauggaugcuaauugaagcugaacuaaagugcuucgggaacacagcuguggcaaaauguaaugagaaacaugaugaggaauuuugugacaugcugaggcuguuugacuucaauaaacaagccauucaaagguugaaaacugaagcacaaaugagcauucaguugaucaacaaagcaguaaaugcuuugauaaaugaccaacuuauaaugaagaaccaucuacgggauaucauggggauuccauacuguaauuacagcaaguauugguaccucaaccacacaacuacugggaaaacaucacugcccagauguuggcuuguaucaaaugguucauaccugaaugagacccacuuuucugaugauaucgaacaacaagcugacaauaugaucacugagaugcuacagaaggaguauauggagaggcaggggaagacaccauugggucugguugaccucuuuguguucagcacaagcuucuaucucaucagcaucuuccuucaccuaguuaagauaccaacucauaggcauauugugggcaagccgugucccaaaccucacagauugaaucauaugggcauuuguuccuguggacucuacaaacagccuggugugccugugaaauggaagagauga

SEQ ID NO: 439 - RNA, 1476 nt, Artificial Sequence
  derived and/or modified CDS sequence (wt) from Lassa virus__AIT17298__GPC
augggacaaauagugacauucuuccaagaagugccucauguaauagaagaggugaugaacauuguucucaucgcacugucuauacuagcagugcugaagggucuguacaacauugcaacauguggccuccuuggcuuggucugcuuccucuuguuguguggcaggucuugcacaaccagucuuuacaaagggguuuaugagcuucagacucuggagcuaaacauggagacacucaacaugaccaugccucucucuugcacaaagaacaacagucaucauuacauaauggugggcaaugagacaggacuggaacugacuuugaccaacacaagcauuauuaaucauaaauuuugcaaucugucugacgcccauaagaagaaccucuaugaccacgcucuuaugagcauaaucucaacuuuccacuuguccauccccaacuucaaucaguaugaagcaaugagcugugauuuuaaugggggaaagaucaguguacaguacaaucuuagucacagcuaugcuguggaugcagccagccauuguggcacaaucgcaaauggugucuuacagacuuucaugaggauggccuggggugggaguuacauugcucuugauucuggccauggagggugggacugcauaaugaccaguuaucaauauuugauaauccaaaacacaaccugggaagaucacugccaauucucaagaccaucuccuauugguuaucuugggcuccucucgcagagaaccagagauauuuauauuaguaggagacuacugggcacauucacauggacauugucagauucugaaggcaaggacacaccagggggguauugucugaccagauggaugcugauugaggcugaacugaaaugcuucgggaauacagcuguggcaaaguguaaugagaaacacgaugaggaauuuugugauaugcugaggcuguuugacuucaacaaacaagccauucaaagguuaaaagcugaggcacaaaugagcauucaguugaucaacaaagcaguaaaugcucuaauaaaugaccaacuaauaaugaagaaccaucuacgggacaucaugggaauuccauacuguaauuacagcaaguacugguaccucaaccacacaacuacugggaaaacaucacugcccaaauguuggcuuguaucgaaugguucauacuuaaacgagacccacuuuucugaugauauugaacaacaggcugacaacaugaucacugagauguuacagaaagaguacauggaaaggcaggggaagacaccauugggucuaguugaccucuuuguguucagcacaaguuucuaucucauuagcaucuuccuucauuuagucaagauaccaacucacaggcauguuguaggcaagccgugucccaaaccucacagauugaaucacaugggcauaugcuccugcggacucuauggacagccugguguaccugugaaauggaagagauga

SEQ ID NO: 440 - RNA, 1476 nt, Artificial Sequence
  derived and/or modified CDS sequence (wt) from Lassa virus__AIT17302__GPC
augggacaaauagugacuuucuuccaggaggugccucaugugauagaggaggugaugaacauugugcucaucgcauugucucuacuggcaguguugaaaggucuguacaauguugcaacauguggccucauuggucuggucaccuuccuuuugcugugugguagauccuguacaaccaaucuuuacaaaggaguuuaugagcuucagacucuggaacuaaauauggagacacucaauaugaccaugccucucucuugcacaaagaacaauagucaccacuauauaaugguggguaaugagacgggacuggaacugaccuugaccaacacaaguaucaucagccacaaguuuuguaaucugucugaugcucacaaaaagaaucucuaugaucacacccuuaugagcauaauuucgacuuuucauuuguccauucccaacuucaaucaguaugaagcaaugagcugugacuucaauggagggaaaauuagugugcaauacaaccuaagccacagcuaugcuguggaugcagccaaccauuguggcacaguugcaaaugguguccuacagacuuucaugaggauggcuuggggugggagcuauauugcccuugauucaggccgugguaauugggauuguauuaugacuaguuaccaauaucuaauaauucaaaauacaaccugggaagaucacugccaguucucaagaccaucucccaucggcuaucuugggcuccucucacaaaggaccagagacauuuacauuaguagaagacuacugggcacauucacauggacacuaucggauucugaaggcaaugacacaccagggggauacugccugaccagguggauguuaauugaagcugaguugaaaugcuucgguaacacagcuguagccaaaugcaaugaaaaacaugaugaagaauucugugacaugcugagacuguuugacuuuaacaaacaagccauucaaagauuaaaggcugaggcacaaaugaguauccaguugaucaacaaggcagugaaugcucugauuaaugaccaauugauaaugaaaaaccaucuacgggacaucauggggauuccauacuguaacuauaguaaguacugguaucucaaccacacaaccacugggaaaacaucguugcccaaauguuggcuugugucuaaugguucauaucuaaacgagacccacuuuucugaugacauugaacagcaagccgacaacaugauaacugaaauguugcaaaaagaguacauggagagacaggggaagacaccauuaggucugguugaccucuuuguguucagcacaaguuucuaccucauuagcaucuuucuucaccuggucaaaauaccaacacauagacacauuguuggcaaaccguguccgaaaccucacaggcugaaucacaugggcauauguuccuguggacucuacaaacaaccugguguaccugucagauggaagagauga

SEQ ID NO: 441 - RNA, 1476 nt, Artificial Sequence
  derived and/or modified CDS sequence (wt) from Lassa virus__AIT17310__GPC
augggacaaauagugacauucuuccaggaggugccccaugugauagaagaggugaugaacauuguucucauugcacugucuauacuagcaguguugaagggucuguacaaucuugcaacauguggccuuguuggcuuggucacuuuccuccuguuguguggcaggucuuguacaacuagccuuuacaaagggguuuaugagcuucagacucuggaacuaaacauggaaacacucaauaugaccaugccucucuccugcacaaagaacaauagucaucauuacauaauggugggcaaugagacaggacuggaacugaccuugaccaacacgagcaucauuaaucauaaauuuugcaaucugucugaugcccacaaaaagaaucucuaugaccacgcucuuaugagcauuaucucaaccuuccacuuguccaucccuaacuucaaucaguaugaggcaaugagcugcgauuuuaaugggggaaagaucagugugcaguacaaccugagucacagcuaugccggggaugcagccacucacuguggcacugucgcaaaugguguauuacagacuuucaugaggauggcuuggggugggagcuacauugcucuugacucaggccguggcaagugggacuguaucaugacuaguuaucaauaucugauaauccaaaauacaaccugggaagaucacugccaauucucgagaccaucucccauugguuaucuugggcuccuuucacaaaggaccagagauauuuacauuaguagaaggcuacuaggcacauucacauggacacugucagauucugaaggcaaggacacaccagggggauauugucuaaccagauggaugcugauugaagcugaacuaaagugcuucgggaacacagcuguggcaaaauguaaugagaagcaugaugaggaauuuugugacaugcugagguuguuugacuuuaauaaacaagccauucaaagguuaaaaacugaagcacaaaugagcauucaguugaucaacaaagcaguaaaugcuuugauaaaugaccaacuuauaaugaagaaccaucuacgggauaucauggggauuccauacuguaauuacagcaaguauugguaccucaaccacacaacuacugggaaaacaucacugcccagauguuggcuuguaucaaaugguucauaccugaacgagacccacuuuucugaugauaucgaacaacaagcugacaauaugaucacugagaugcuacagaaggaauauauggagaggcaggggaagacaccauugggucugguugaccucuuugucuucagcacaagcuucuaucucaucagcaucuuccuucaccuaguuaagauaccaacucauaggcauauuguaggcaagccgugucccaaaccucacaggcugaauuauaugggcauuuguuccuguggacucuacaaacagccuggugugccugugaaauggaagagauga

SEQ ID NO: 442 - RNA, 1476 nt, Artificial Sequence
  derived and/or modified CDS sequence (wt) from Lassa virus__AIT17314__GPC
augggacaaauagugacauucuuccaagaaguaccccauguaauagaagaggugaugaacauuguucucauuacauugucuauacuagcaguguugaaaggucuguacaauguugcgacauguggccucguuggcuuggucacuuuccuccuguuguguggcaggucuugcacaaccagccuuuacaaagggguuuaugagcuucagacucuggaacuaaacauggaaacacucaauaugaccaugccucucuccugcacaaagaacaauagucaucauuacauaauggugggcaaugagacaggacuagaacugaccuugaccaacacgagcauuauuaaucauaaauuuugcaaucugucugaugcccacaaaaaagaccucuaugaccacgcucucaugagcaucaucucaaccuuccacuuguccaucccuaacuucaaucaguaugaggcaaugagcugcgauuuuaaugggggaaagauuagugugcaguacaaccugagucacagcuaugccguggaugcagccaaccauuguggcacuguugcaaaugguguauuacagacuuucaugaggauggcuuggggugggagcuacauugcucuugacucaggcagaggcgggugggacuguauuaugacuaguuaucaauaucugauaauccaaaauacaaccugggaagaucacugccaauucucgagaccaucucccaucgguuaucucgggcuccucucacaaaggaccagggauauuuauaucaguagaagguugcugggcacauucacauggacacugucagauucugaaggcaaugacacaccagggggauauugucuaaccagauggaugcuaauugaagcugaacuaaagugcuucgggaacacagcuguggcaaaguguaaugagaagcaugaugaggaauuuugugacaugcugaggcuguuugacuucaacaaacaagccauucaaagguugaaagcugaagcacaaaugagcauucaguugaucaacaaagcaguaaaugcuuugauaaaugaccaacuuauaaugaaaaaccaucuacgagacaucauggggauuccauacuguaauuacagcaaguauugguaccucaaccacacaacuacugggaaaacaucacugcccaaauguuggcuuguaucaaaugguucauaccugaacgagacccacuuuucugaugauauugaacaacaagcugacaacaugaucacugagauguuacagaaggaguauauggagaggcaggggaagacaccauugggucugguugaccucuuuguguucagcacaagcuucuaucucauuagcaucuuccuucaccuaguuaaaauaccaacucauaggcauauuguaggcaagccgugucccaaaccucacagacugaaucauauggguauuuguuccuguggacucuacaaacagccuggugugccuguuaaauggaagagauga

SEQ ID NO: 443 - RNA, 1476 nt, Artificial Sequence
  derived and/or modified CDS sequence (wt) from Lassa virus__AIT17318__GPC
augggacaaauagugacuuucuuccaggaagugccucaugugauagaggaggugaugaacauugugcucaucgcauugucuuuacuggcaguuuugaaaggucuguacaauguugcaacauguggccucauuggucuggucaccuuccuuuuacuguguggcagauccugcacaaccaaucuuuacaaaggagucuaugagcuucagacucuggaacuaaauauggagacacucaauaugaccaugccucucucuugcacaaagaacaauagucaccacuauauaaugguggguaaugagacgggacuggaauugaccuugaccaacacaagcaucaucaaccacaaguuuuguaaucugucugaugcucacaaaaagaaucucuaugaucacgcccuuaugagcauaaucucgacuuuucacuuguccauucccaacuucaaucaguaugaagcaaugagcugugacuucaauggagggaaaauuagugugcaguacaacuuaagccacagcuaugcuguggaugcagccaaccacuguggcacaguugcaaaugguguccugcagacuuucaugaggauggccuggggugggagcuauauugcccuugauucaggccgugguaauugggauuguaucaugacuaguuaccaauaucuaauaauucagaauauaaccugggaagaucacugccaguucucaagaccaucucccaucggcuaucuugggcuucucucacaaaggaccagagacauuuacauuaguagaagacuacugggcacauucacauggacacuaucagauucugaaggcaaugacacaccagggggauacugucugaccagguggauguuaauugaagcugaacugaaaugcuucgguaacacagcuguggccaaaugcaaugaaaaacaugaugaagaauucugugacaugcugagacuguuugacuuuaacaaacaagccauucaaagauuaaaggcugaggcacaaaugaguauccaguugaucaacaaggcagugaaugcucuaauuaaugaccaauugauaaugaaaaaccaucuacgggacaucauggggauuccauacugcaacuauaguaaguauugguaucucaaccacacaaccacuggaaaaacaucguuacccaaaugcuggcuugugucuaaugguucauaccuaaacgagacccacuuuucugaugacauugaacagcaagccgacaacaugauaacugaaauguuacaaaaagaguacauggagagacaggggaagacaccauuaggucugguugaccucuuuguguucagcacaaguuucuaccucauuagcauuuuucuucaccuagucaaaauaccaacacauaggcacauuguuggcaaaccguguccgaaaccucacaggcugaaucacaugggcauauguuccuguggacucuacaaacaaccugguguaccugucagauggaagagauga

SEQ ID NO: 444 - RNA, 1476 nt, Artificial Sequence
  derived and/or modified CDS sequence (wt) from Lassa virus__AIT17322__GPC
augggacaaauaguaacuuucuuccaggaggugccucaugugauagaggaggugaugaacauugugcucaucgcauugucucuacuggcaguguugaaaggucuguacaauguugcaacauguggccucauuggucuggucaccuuccuuuuacugugugguagauccugcacaaccaaucuuuacaaaggagccuaugagcuucagacucuggaacuaaauauggagacacucaauaugaccaugccucucucuugcacaaagaacaauagucaccacuauauaaugguggguaaugagacgggacuggaauugaccuugaccaacacaagcaucaucaaccacaaguuuugcaaucugucugaugcucacaaaaagaaucucuaugaucacacccuuaugagcauaaucucgacuuuucacuuguccauucccaacuucaaucaguaugaagcaaugagcugugacuucaauggagggaaaauuagugugcaguacaacuuaagccacagcuaugcuguggaugcagccaaccauugugguacaguugcaaaugguguccuacagacuuucaugaggauggccuggggugggagcuacauugcccuugauucaggccgugguaauugggauuguauuaugaccaguuaccaauaucuaauaauucagaauacaaccugggaagaucacugccaguucucaagaccaucucccaucggcuaucuugggcuccucucacaaaggaccagagacauuuacauuaguagaagacuacugggcacauucacauggacacuaucagauucugaaggcaaugacacaccagggggauacugucugaccagguggauguuaauugaggcugagcugaagugcuucgguaacacagcuguagccaaaugcaaugaaaaacaugaugaagaauucugugacaugcugagacuguuugacuuuaacaaacaagcuauucaaagauuaaaggcugaggcacaaaugaguauccaguugaucaacaaggcagugaaugcucuaauuaaugaccaauuaauaaugaaaaaccaucuacgggacaucauggggauuccauacuguaacuauaguaaguauugguaucucaaccacacaaccacuggaaaaacaucauugcccaagugcuggcuuguaucuaaugguucauaucuaaacgagacccacuuuucugaugacauugaacagcaagccgacaacaugauaacugaaauguugcaaaaggaguacauggagagacaggggaagacaccauuaggucugguugaccucuuuguguucagcacaaguuucuaccucauuaguauuuuucuucaccuagucaaaauaccaacacauaggcacauuguuggcaaaccguguccgaaaccucacaggcugaaucauaugggcauauguucuuguggacucuauaaacaaccugguguaccugucagauggaagagauga

SEQ ID NO: 445 - RNA, 1476 nt, Artificial Sequence
  derived and/or modified CDS sequence (wt) from Lassa virus__AIT17328__GPC
augggacaaauagugacauucuuccaagaagugccucauguaauagaagaggugaugaacauuguucucauuacacugucuauacuggcaguguugaaaggucuguacaacauugcaacauguggccuuguugguuuggucacuuuccuccuguugugugguaagucuugcacaaccagccucuauaaagggguuuaugagcuccagacucuggaacuaaacauggagacacucaauaugaccaugccucucuccugcacaaagaacaacagucaucauuauauaagggugggcaaugagacaggacuagaacugaccuugacuaacacgagcauuauuaaucauaaauuuuguaaucugucugaugcccacaaaaagaaccucuaugaccacgcucuuaugagcauaaucucaacuuuccacuuguccauccccaacuucaaucaguaugaggcgaugagcugcgauuuuaaugggggaaaaauuagugugcaguacaacuugagucauagcuaugcuguagaugcagccaaccauuguggcacuguugcaaaugguguauugcagacuuucaugaggauggcuuggggugggagcuacauugcucuugacucaggucaugguaauugggacuguaucaugacuaguuaucaauauuuaauaauccaaaauacaaccugggaagaucacugccaauucucgagaccaucuccuaucgguuaccuugggcuccucucacaaaggaccagagauauuuacauuagcagaagacuacuaggcacauucacauggacacuaucagauucugaaggcaaugacgcaccagggggauauugucugaccagauggaugcuaauugaggcugaacuaaaaugcuucgggaacacagcuguagcaaaauguaaugagaaacaugaugaggaguuuugugacaugcugaggcuguuugacuucaauaaacaagccauucaaagguugaaagcugaagcacaaaugagcauucaguugaucaacaaagcaguaaaugcuuuaauaaaugaccaacucauaaugaagaaccaccugcgggacaucaugggaauuccauacuguaauuacagcaaguauugguaccucaaccacacaacuacugggaaaacaucacugcccaaauguuggcuuguaucaaaugguucguacuugaacgagacucacuuuucugaugauauugaacaacaagcugacaacaugaucacugagauguuacagaaggaguacauggagaggcaggggaagacaccauugggccugguugaccucuuuguguucagcacaaguuucuaucucauuagcaucuuccuccaccuggucaaaauaccaacucauaggcauguuguaggcaagucgugucccaaaccucacagacugaaucacaugggcauauguucuuguggacucuacaaacagccuggugugccuguaaaauggaagagauga

SEQ ID NO: 446 - RNA, 1476 nt, Artificial Sequence
  derived and/or modified CDS sequence (wt) from Lassa virus__AIT17332__GPC
augggacaaauagugacauucuuccaggaagugccucauguaauagaagaggugaugaacauuguucucauugcacugucuauacuggcagugcugaaaggucuguacaaucuugcaacauguggccucguugguuuggucacuuuccuccuguugugugguaggucuugcacaaccagucuuuacaaagggguuuaugagcuucagacucuggaacuaaacauggagacacucaacaugaccaugccucucuccugcacaaagaacaacagucaucauuauauaagggugggcaaugagacaggacuagaacugaccuugaccaacacgagcauuauuaaucacaaguuuugcaaccugucugaugcccacaaaaagaaccucuaugaccacgcccucaugagcauaaucucaacuuuccacuuguccauccccaacuucaaucaguaugaggcaaugagcugcgauuucaaugggggaaagauuagugugcaguacaaccugagucacagcuaugccguagaugcagccaaucauuguggcacuguugcaaaugguguacugcagacuuucaugaggauggcuuggggugggagcuacauugcucuugacucaggucaugguagaugggacuguaucaugacuaguuaucaauaucugauaauccaaaauacaaccugggaagaucacugccuauucucgagaccaucucccaucgguuaucucgggcuccucucacaaagaacuagagauauuuauaucaguagaagacuacuaggcacauucacauggacauugucagauucugaaggcagggacacaccagggggauauugucuaaccagguggaugcuaauugaggcugaacuaaaaugcuucgggaacacagcuguggcaaaauguaaugaaaaacaugaugaggaauuuugugacaugcugaggcuguuugacuucaacaaacaagccauucaaagguugaaagcugaagcacaaaugagcauucaguuaaucaacaaagcaguaaaugcuuugauaaaugaucaacuuauaaugaagaaccaucuacgggacaucaugggaaucccauacuguaauuacagcaaauauugguaccucaaccacacaacuacuggaagaacaucacugccuagauguuggcuuguaucaaaugguucauaccugaacgaaacccacuuuucugaugauauugaacaacaagcugacaacaugaucacugagauguuacaaaaagaguauauggaaaggcaggggaagacaccauugggccuaguugaucucuuuguguuuagcacaaguuucuaccuuauuagcaucuuucuucaccuagucaaaauaccaacucauaggcauauuguaggcaagucgugucccaaaccucacagacugaaucacaugggcauuuguuccugugggcucuacaaacagccuggugugccuguaaaauggaagagauga

SEQ ID NO: 447 - RNA, 1476 nt, Artificial Sequence
  derived and/or modified CDS sequence (wt) from Lassa virus__AIT17340__GPC
augggacaaauagugacauucuuccaggaagugccccaugucauagaagaggugaugaacaucguucucauugcacugucuauacuagcaguguugaaaggucuguacaacuucgcaacauguggccucguuggcuuggucacuuuccuccuguuguguggcaggucuugcacaacuagccuuuacaaggggguuuaugagcuucagacucuggaacuaaacauggaaacacucaauaugaccaugccucucuccugcacaaagaacaauagucaucauuauauaauggugggcaaugagacaggacuagaacugaccuugaccaacauaagcauuauuaaccauaaauuuugcaaucugucugaugcccacaaaaagaaccucuaugaccacgcucucaugagcauuaucucaacuuuccacuuguccaucccuaacuucaaucaguaugaggcaaugagcugcgauuucaaugggggaaagauuaguguacaauacaaccugagccacagcuaugccggggacgcagccaaccauuguggcacuguugcaaaugguguauuacagacuuucaugaggauggcuuggggugggagcuacaucgcucuugacucaggccguggcgagugggacuguauuaugacgaguuaucaauaucugauaauccaaaauacaaccugggaagaucacugccaauucucgagaccaucucccaucgguuaucucgggcuccucucacaaaggaccagagauauuuauauuaguagaaggcuacuaggcacauucacauggacacugucagauucugaaggcaaggacacaccagggggauauugucuaaccagauggaugcuaauugaggcugagcuaaagugcuucgggaacacagcuguggcaaaauguaaugagaagcaugaugaggaauuuugugacaugcugagguuguuugacuuuaacaaacaagccauucaaagguugaaagcugaggcacaaaugagcauucaguuaaucaacaaagcaguaaaugcuuugauaaaugaccaacuuauaaugaagaaccaucuacgggacaucauggggauuccauacuguaauuacagcaaguauugguaccucaaccacacaacuacuggaaaaacaucacugcccaaguguuggcuuguuucaaaugguucauaccugaacgagacccacuuuucugaugacauugaacaacaagcugacaacaugaucacugagauguuacagaaggaguauauggagaggcaggggaagacaccauugggucugguugaccucuuuguguucagcacaagcuucuaucucauuagcaucuuccuucaccuaguuaaaauaccaacucauaggcauauuguaggcaagccgugucccagaccucacagguugaaucauaugggcauuuguuccuguggacucuauaaacagccuggugugccuguaaaauggaagagauga

SEQ ID NO: 448 - RNA, 1476 nt, Artificial Sequence
  derived and/or modified CDS sequence (wt) from Lassa virus__AIT17344__GPC
augggacagauaguaacauucuuccaggaagugccucaugugauagaagaggugaugaacauuguucucauugcacugucuauauuagcagugcugaaaggucuguacaauuuugcaacauguggccucguugguuugguuaccuuccuccuguuaugugguaggucuugcacaaccagucuuuacaaagggguuuaugagcuucagacucuggaacuaaacauggagacacucaauaugaccaugccucucuccuguacaaagaacaacagucaucauuauauuaugguggguaaugagacaggacuagaacugaccuugaccaacacgagcaucauuaaucauaaauuuugcaaucugucugaugcccacaaaaagaaccucuauaaucacgcucuuaugagcauaauuucaacuuuccaucuguccauucccaacuucaaucaguaugaggcaaugagcugcgauuucaaugggggaaagauuagugugcaguacaaccugagucacaguuaugcuggggaugcggccagccauuguggcacuguugcaaauggugucuuacagacuuucaugaggauggcuugggguggaagcuauauugcucuugacucaggcuauggcaagugggacugcauuaugacuaguuaucaguaccugauaauucaaaauacaaccugggaagaucacugccaauucucaagaccaucucccauuggcuaucucgggcuccucucacaaaggaccagagauauuuauauuaguagaagacugcugggcacauucacauggacacugucggauucugaagguaaggacacaccagggggauauuguuugaccagauggaugcuaauugaagcugaacuaaagugcuucgggaacacagcuguagcaaaauguaaugagaagcaugaugaggaauuuugugacaugcugaggcuguuugacuucaacaaacaagccauucaaagauugaaaacugaagcacaaaugagcauucaguugaucaacaaggcaguaaaugccuuaauaaaugaccagcuuauaaugaagaaccaucuacgagacauaaugggaauuccauacuguaacuacagcaaguauugguaccucaaccacacaaccacugggaaaacaucacugccuaaauguuggcuuguaucaaauggcucauacuugaaugagacccacuuuucugaugauauugaacaacaggcugacaacaugaucacugagauguuacagaaagaguacauggagaggcaggggaagacaccauugggccuggucgaccuuuuuguguucagcacaaguuucuaucucaucaguaucuuucuucaccuagucaaaauaccaacucauagacauauuguaggaaagucgugucccaaaccucacagauugaaucacaugggcauauguuccuguggacucuacaaacagcccggugugccugugagauggaagagauga

SEQ ID NO: 449 - RNA, 1476 nt, Artificial Sequence
  derived and/or modified CDS sequence (wt) from Lassa virus__AIT17348__GPC
augggacaaauagugacauucuuccaagaaguaccccauguaauagaagaggugaugaacauuguucucauugcacugucuauacuagcaguguugaaaggucuguacaauauugcgacauguggccucauuggcuuggucacuuuccuccuguuguguggcaggucuugcacaacuagccuuuacaaagggguuuaugaacuucagacucuggaacuaaacauggaaacacucaauaugaccaugccucucuccugcacaaagaacaauagucaucauuacauaauggugggcaaugagacaggauuagaacugaccuugaccaacacgagcauuauuaaucauaaauuuuguaaucugucugaugcccacaaaaagaaccucuaugaccacgcucucaugagcauuaucucaaccuuccacuuguccaucccuaacuucaaucaguaugaggcaaugagcugcgauuuuaaugggggaaagaucagugugcaguauaaccugagucacagcuaugccggggaugcagccaaccacuguggcacuguugcaaaugguguacuacagacuuucaugaggauggcuuggggugggagcuacauugcucuugacucaggcagaggcaggugggauuguauuaugacuaguuaucaauaucugauaauccaaaauacaaccugggaagaucacugccaauucucgagaccaucucccaucggcuaucucgggcuccucucacaaaggaccagggacauuuacauuaguagaagguugcuaggcacauucacauggacacugucagauuccgaaggcaaugacacaccagggggauauugucuaaccagauggaugcuaauugaagcugaacuaaagugcuucgggaacacagcuguggcaaaguguaaugagaagcaugaugaggaauuuugugacaugcugaggcuguuugacuucaacaaacaagccauucaaagguugaaagcugaggcacaaaugagcauucaguugaucaacaaagcaguaaaugcuuuaauaaaugaccaacucauaaugaagaaccaucuacgagacaucauggggauuccauacuguaauuacagcaaguauugguaccucaaccacacaacuacugggaaaacaucacugcccaaauguuggcuuguaucaaauggaucauaccugaacgagacccacuuuucugaugauauugaacaacaagcugacaacaugaucacugagauguuacagaaggaguauauggagaggcaggggaagacaccauugggucugguugaccucuuuguguucagcacaagcuucuaucucauuagcaucuuccuucaccuaguuaaaauaccaacucauaggcauauuguaggcaagccgugucccaaaccucacagguugaaucauaugggcauuuguuccuguggacucuauaaacagccuggugugccuguuaaauggaagagauga

SEQ ID NO: 450 - RNA, 1476 nt, Artificial Sequence
  derived and/or modified CDS sequence (wt) from Lassa virus__AIT17350__GPC
auggggcaaauagugacuuuuuuccaggaagugccucaugugauagaggaggugaugaacauuguacucaucgcacugucuauacuugcggugcuaaaagguuuguacaauguugcaacauguggucuuauugguuugguuaccuuucuuuuacugugugguagaucuuguacaaccacucuguacaaaggaguuuaugaacuucaggccuuggaauugaacauggagacacucaauaugaccaugccucucucuugcacaaagaacaauagccaucauuauauaaugguaggcaaugagacaggacuggaacuaaccuugaccaauacaaguaucaucgaucacaaguuuugcaaccugucugaugcccacaaaaagaaccucuaugaucaugcucuuaugaguauaaucucaacuuuccacuuguccauucccaacuuuaaucaguaugaagcaaugaguugugacuuuaauggagggaaaauuaguguacaauacaaccuaagucacagcuaugcuggagaugcagccaagcauuguggcacaguugcgaauggcguuuugcagaccuucaugagaauggccuggggugggaguuacauugcucuugacucaggucgcaauggaugggauuguguuaugacuaguuaucaauaucuaauaauucaaaacacaaccugggaagaucacugccaguucucaagaccaucucccauuggcuaccuugggcuccucucacaaaggaccagagacauuuacauuaguagaagacugcugggcacauucacauggacacugucagauucugaaggcaaagauacaccagggggguacugucugacuagauggaugcuaauugaggcugaacugaaauguuucggcaacacagcuguugccaaauguaaugagaagcaugaugaagaauucugugauaugcugaggcuauuugacuucaacaagcaagccauccaaagguuaaagacugaagcacaaaugagcauucaguugaucaacaaggcugugaaugcuuuaauaaaugaucaacugauaaugaaaaaccaucugcgggauaucauggggauuccauacuguaacuacagcaaguacugguaucucaaccacacaguuacugggaaaacaucacugccuagaugcuggcuuguaucaaauggcucauauuuaaacgagacccacuucucugaugacauugagcaacaagcugacaacaugaucacugagauguugcaaaaggaguacauagagaggcaggggaagacaccauugggucugguugaccucuuuguguucagcacaaguuuuuaucucauuaguaucuuccuucaccuagucaaaauaccaacucauagacacauuauaggcaaaccguguccaaaaccucacaggcugaaucauaugggcauaugcuccugugggcucuauaaacaaccuggugugccuguaagauggaagagauaa

SEQ ID NO: 451 - RNA, 1476 nt, Artificial Sequence
  derived and/or modified CDS sequence (wt) from Lassa virus__AIT17354__GPC
augggacaaauagugacauucuuccaggaagugccccauguuauagaagaggugaugaacaucguucucauugcacugucuauacuagcaguguugaaaggucuguacaacuucgcaacauguggccucguuggcuuggucacuuuccuccuguuguguggcaggucuugcacaacuagccuuuacaaggggguuuaugagcuucagacucuggaacuaaacauggaaacacucaauaugaccaugccucucuccugcacaaagaacaauagucaucauuauauaauggugggcaaugagacaggacuagaacugaccuugaccaacauaagcauuauuaaccauaaauuuugcaaucugucugaugcccacaaaaagaaccucuaugaccacgcucuuaugagcauuaucucaacuuuccacuuguccaucccuaacuucaaucaguaugaggcaaugagcugcgauuucaaugggggaaagauuaguguacaguacaaccugagccacagcuaugccggggacgcagccaaccauuguggcacuguugcaaaugguguauuacagacuuucaugaggauggcuuggggugggagcuacaucgcucuugacucaggccauggcgggugggacuguauuaugacgaguuaucaauaucugauaauccaaaauacaaccugggaagaucacugccaauucucgagaccaucucccaucgguuaucucgggcuccucucacaaaggaccagagauauuuauauuaguagaaggcuacuaggcacauucacauggacacugucagauucugaaggcaaggacacaccagggggauauugucuaaccagauggaugcuaauugaggcugagcuaaagugcuucgggaacacagcuguggcaaaauguaaugagaagcaugaugaggaauuuugugacaugcugagguuguuugacuuuaacaaacaagccauucaaagguugaaagcugaggcacaaaugagcauucaguugaucaacaaagcaguaaaugcucugauaaaugaccaacuuauaaugaagaaccaucuacgggacaucauggggauuccauacuguaauuacagcaaguauugguaccucaaccacacaacuacuggaaaaacaucacugcccaaguguuggcuuguuucaaaugguucauaccugaacgagacccacuuuucugaugacauugaacaacaagcugacaacaugaucacugagauguuacagaaggaguauauggagaggcaggggaagacaccauugggucugguugaccucuuuguguucagcacaagcuucuaucucauuagcaucuuccuucaccuaguuaaaauaccaacucauaggcauauuguaggcaagccgugucccagaccucacagguugaaucauaugggcauuuguuccuguggacucuauaaacagccuggugugccuguaaaauggaagagauga

SEQ ID NO: 452 - RNA, 1476 nt, Artificial Sequence
  derived and/or modified CDS sequence (wt) from Lassa virus__AIT17360__GPC
augggacaaauagugacauucuuccaggaagugccucauguaauagaagaggugaugaacauuguucucauugcacugucaauauuggcagugcuaaaaggucuguauaauuuugcuacauguggccucguugguuuggucacuuuccucuuacuguguggcaggucuugcacaaccagccuuuacaaaggaguuuaugagcuucagacucuggaacuaaacauggagacucucaauaugaccaugccucucucuugcacaaagaacaauagucaucauuacauaagggugggcaaugagacagggcuagaacugaccuuaaccaacacaagcauuauuaaucaucgauuuugcaaucugucugaugcccacaaaaagaaccuuuaugaccacgcucuuaugagcauaaucucaacuuuccacuuguccaucccuaacuucaaucaguaugaggcaaugagcugugauuuuaaugggggaaagauuagugugcaauacaaccuaagucacagcuaugcuggggaugcagccaaccauuguggcacaguugcaaaugguguccugcagacuuucaugaggauggccugggguggaagcuacauugcucuugacucaggccauggcaagugggacuguauuaugaccagcuaucaauaccugauaauccaaaauacaaccugggacgaucauugccaguucucgagaccaucucccaucgguuaucucggucuccuuucgcaaaggaccagagacauuuauauuaguagaagacuacuaggcacauucacauggacacugucagauucugaaggcaaggacacaccagggggauauugucugacuagauggaugcugauugaggcugaacuaaaaugcuucgggaacacagcuguggcaaaaugcaaugagaaacaugacgaagaauucugugauaugcugaggcuguuugacuucaacaaacaggccauucgaagguuaaaagccgaagcacaaaugagcauucaguuaauuaacaaagcaguaaaugcucugauaaaugaucaacuaauaaugaagaaccaucuacgggauaucaugggaauuccauacuguaauuacagcaaauacugguaccucaaccacacaacuacugggaaaacaucacugcccagauguuggcuuguaucaaauggaucauauuugaaugagacccacuuuuccgaugacauugagcaacaagcugacaauaugaucacugagauguugcagaaagaguauauggagagacaggggaaaacaccauuaggccuaguugaccucuuuguguucagcacaaguuuuuaucucauuagcaucuuccuucacuuagucaaaauaccaacucauaggcauauuguaggcaagucguguccaaaaccucacagguugaaucacauggguauauguuccugcgguuucuauaaacagcccggugugccugugaaauggaagagauga

SEQ ID NO: 453 - RNA, 1476 nt, Artificial Sequence
  derived and/or modified CDS sequence (wt) from Lassa virus__AIT17364__GPC
augggacaaauagugacauucuuccaggaagugccccaugucauagaagagguaaugaacaucguucucauugcacugucuauacuagcaguguugaaaggucuguauaauuuugcaacauguggccucguuggcuuagucacuuuccuccuguuguguggcaggucuugcacaacuagccuuuacaaggggguuuaugagcuucagacucuggaacuaaacauggaaacacucaauaugaccaugccucucuccugcacaaagaacaacagucaucauuauauaauggugggcaaugaaacaggacuagaacugaccuugaccaacacgagcauuauuaaucauaaauuuugcaaucugucugaugcccacaagaagaaccucuaugaccacgcucuuaugagcauuaucucaacuuuccacuuguccaucccuaacuucaaucaguaugaggcaaugagcugcgauuucaaugggggaaagauuagugugcaguacaaccugagucacagcuaugccggggacgcagccaaccauuguggcacuguugcaaaugguguauuacagacuuucaugaggauggcuuggggugggagcuacauugcucuugacucaggccgugacaggugggacuguauuaugacuaguuaucaauaucugauaauccaaaauacaaccugggaagaucacugucaauucucgagaccaucucccaucgguuaucucgggcuccucucacaaaggaccagagauauuuauauuaguagaaggcuacuaggcacauucacauggacacugucagauucugaaggcaaggacacaccagggggauauugucuaaccagauggaugcuaauugaggcugagcuaaagugcuucgggaacacagcuguggcaaaguguaaugagaagcaugaugaggaauuuugugacaugcugaggcuguuugacuuuaacaaacaagccauucaaagguugaaagcugaagcacaaaugagcauucaguugaucaacaaggcaguaaaugcuuugauaaaugaccaacuuauaaugaagaaccaucuacgggacaucauggggauuccauacuguaauuacagcaaguauugguaccucaaccacacaacuacuggaaaaacaucacugcccaaguguuggcuuguaucaaaugguucauaccugaacgagacccacuuuucugaugacauugaacaacaagcugacaacaugaucacugagauguuacagaaggaguauauagagaggcaggggaagacaccauugggucugguugaccucuuuguguucagcacaagcuucuaucucauuagcaucuuccuucaccuaguuaaaauaccaacucauaggcauauugugggcaagccguguccuaaaccucacagguugaaucauaugggcauuuguuccuguggacucuauaaacagccuggugugucugugaaauggaagagauga

SEQ ID NO: 454 - RNA, 1476 nt, Artificial Sequence
  derived and/or modified CDS sequence (wt) from Lassa virus__AIT17368__GPC
augggacaaauagugacauucuuccaggaagugccucauguaauagaagaggugaugaacauuguucucauugcacugucaauauuggcagugcuaaaaggucuguauaauuuugcuacauguggccucguugguuugguuacuuuccucuuacuguguggcaggucuugcacaaccagccuuuacaaaggaguuuaugagcuucagacucuggaacuaaacauggagacucucaauaugacuaugccucucucuugcacaaagaacaauagucaucauuacauaauggugggcaaugagacagggcuagaacugaccuuaaccaacacgagcauuauuaaucauaaauuuugcaaucugucugaugcccacaaaaagaaccuuuaugaccacgcucuuaugagcauaaucucaacuuuccacuuguccaucccuaacuucaaucaguuugaggcaaugagcugugauuuuaaugggggaaagauuagugugcaguacaaccuaagucacagcuaugcuggggaugcagccaaccauuguggcacaguugcaaaugguguccugcagacuuucaugaggauggccugggguggaagcuacauugcucuugacucaggccauagcaagugggacugcauuaugaccagcuaucaauaccugauaauccaaaacacaaccugggacgaucauugccaguucucaagaccaucucccaucgguuaucuuggucuccuuucgcaaaggaccagagacauuuauauuaguagaagacugcuaggcacauucacauggacucuaucagauucugaaggcaaggacacaccagggggguauugucugacuagauggaugcuaauugaggcugaacuaaaaugcuucgggaacacagcuguggcaaaaugcaaugagaaacaugacgaagaauucugugauaugcugaggcuguuugacuucaacaaacaggccauucaaagguuaaaagccgaagcacaaaugagcauucaguuaauuaacaaggcaguaaaugcucugauaaaugaucaacuaauaaugaagaaccaucuacgggauauuaugggaauuccauacuguaauuacagcaaauacugguaccucaaccacacaacuacugggaaaacaucacugcccaaauguuggcuuguaucaaauggaucauauuugaacgagacccacuuuuccgaugacauugagcaacaagcugacaauaugaucacugagauguugcagaaagaguauauggagagacagggaaaaacaccauugggccuaguugaccucuuuguguucagcacaaguuucuaucucauuagcaucuuccuucacuuagucaaaauaccaacucacaggcauauuguagguaagucguguccaaaaccucacagguugaauuacaugggcauauguuccugcggauucuauaaacagcccggugugccuguaaaauggaagagauga

SEQ ID NO: 455 - RNA, 1476 nt, Artificial Sequence
  derived and/or modified CDS sequence (wt) from Lassa virus__AIT17370__GPC
augggacaaauagugacauucuuccaggaagugccccaugucauagaagaggugaugaacaucguucucauugcacugucuauacuagcaguguugaaaggucuguacaauuuugcaacauguggccucguuggcuuagucacuuuccuccuguuguguggcaggucuugcacaacuagccuuuacaaggggguuuaugagcuucagacucuggaacuaaacauggaaacacucaauaugaccaugccucucuccugcacaaagaacaacagucaucauuauauaauggugggcaaugaaacaggacuagaacugaccuugaccaacacgagcauuauuaaucauaaauuuugcaaucugucugaugcccacaaaaagaaccucuaugaccacgcucuuaugagcauuaucucaacuuuccacuuguccaucccuaacuucaaucaguaugaggcaaugagcugcgauuucaaugguggaaagauuagugugcaguacaaccugagucacagcuaugccggggacgcagccaaccauuguggcacuguugcaaaugguguauuacagacuuucaugaggauggcuuggggugggagcuacauugcucuugacucaggccgugacaggugggacuguauuaugacuaguuaucaauaucugauaauccaaaacacaaccugggaagaucacugucaauucucgagaccaucucccaucgguuaucucgggcuccucucacaaaggaccagagauauuuauauuaguagaaggcuacuaggcacauucacauggacacugucagauucugaaggcaaggacacaccagggggauauugucuaaccagauggaugcuaauugaggcugagcuaaagugcuucgggaacacagcuguggcaaaguguaaugagaagcaugaugaggaauuuugugacaugcugaggcuguuugacuuuaacaaacaagccauucaaagguugaaagcugaagcacaaaugagcauucaguugaucaacaaggcaguaaaugcuuugauaaaugaccaacuuauaaugaagaaccaucuacgggacaucauggggauuccauacuguaauuacagcaaguauugguaccucaaccacacaacuacuggaaaaacaucacugcccaaguguuggcuuguaucaaaugguucauaccugaacgagacccacuuuucugaugacauugaacaacaagcugacaacaugaucacugagauguuacagaaggaguauauggagaggcaggggaagacaccauugggucugguugaccucuuuguguucagcacaagcuucuaucucauuagcaucuuccuucaccuaguuaaaauaccaacucauaggcauauugugggcaagccguguccuaaaccucacagguugaaucauaugggcauuuguuccuguggacucuauaaacagccuggugugucugugaaauggaagagauga

SEQ ID NO: 456 - RNA, 1476 nt, Artificial Sequence
  derived and/or modified CDS sequence (wt) from Lassa virus__AIT17378__GPC
augggacaaauagugacauucuuccaggaagugccucauguaauagaagaggugaugaacauuguucucauugcacugucuauacuagcagugcugaaaggucuguacaaucuugcaacauguggccucguugguuuggucacuuuccuccuguugugugguaggucuugcacaaccagucuuuacaaagggguuuaugagcuucagacucuggaacuaaacauggagacacucaacaugaccaugccucucuccugcacaaagaacaacagucaucauuauauaauggugggcaaugagacaggacuagaacugaccuugaccaacacgagcauuauuaaucauaaauuuugcaaccugucugaugcccacaaaaagaaccucuaugaucacacucuuaugagcauaaucucaacuuuccacuuguccauccccaacuucaaucaguaugaggcaaugagcugcgauuuuaaugggggaaagaucagugugcaguacaaccugagucacagcuaugccguggaugcagccaaccauuguggcacuguugcaaaugguguacuacagacuuucaugaggauggcuuggggugggagcuacauugcucuugacucaggccguagugggugggacugcauuaugacuaguuaucaauaucugguaauccaaaauacgaccugggaagaucacugccaauucucgagaccaucuccuaucgguuaucucgggcuccucucacaaaggaccagagauauuuauaucaguagaagacuacuaggcacauucacauggacacugucagauuccgaaggcaagaacacaccagggggauauugucugaccagguggaugcuaauugaggcugaauuaaaaugcuucgggaacacagcuguggccaaauguaacgagaaacaugaugaggaguuuugugacaugcuaaggcuguuugacuucaacaaacaagccauucaaagguugaaagcugaagcacaaaugagcauucaguugaucaacaaagcagugaaugcuuugauaaaugaucaacuuauaaugaagaaccaucuacgggacauuaugggaaucccauacuguaauuacagcaaguauugguaccucaaccacacaacuacugggagaacaucacugccuagauguuggcuuguaucaaaugguucauaccugaacgagacccacuuuucugaugauauugaacaacaagcugacaacaugaucacugagauguuacagaaggaguauauggaaaggcaggggaagacaccacugggucuaguugaucucuuuguguucagcacaaguuucuaucucauuagcaucuuccuucaccuagucaaaauaccaacucauaggcauauuguaggcaagucaugucccaaaccucacagacugaaucacaugggcauuuguuccuguggguucuauaaacagccuggugugccugugaaauggaagagauga

SEQ ID NO: 457 - RNA, 1476 nt, Artificial Sequence
  derived and/or modified CDS sequence (wt) from Lassa virus__AIT17388__GPC
augggacaaauagugacauuuuuccaggaagugccucaugugauagaggaagugaugaacauuguacucaucgcacugucuauucuugcaguguuaaaggguuuguacaauguugcaacauguggccucauugguuugguuaccuuucuuuuacugugugguagaucuugcacaaccacucuguacaaaggagucuaugaacuucaggcccuggaauuaaacauggagacacucaauaugaccaugccucucucuugcacaaagaacaauagucaccacuauauaaggguggguaaugagacaggacuagaacuaaccuugaccaacacauccaucaucaaucauaaguuuugcaacuuaucugaugcccacaaaaagaaccucuaugaucaugcacuuaugagcauaauuucaacuuuccacuuguccauuccuaacuuuaaucaguaugaagcaaugaguugugacuuuaauggagggauaaucagugugcaguacaaccuaagucacagcuaugcuggagacgcagccaaccauuguggcacaguugcaaauggcguuuugcagaccuucaugaggauggccuggggugggagcuacauugcucuugauucaggccguaaugggugggauugcauuaugaccaguuaucaauaucugauaauucagaauacaaccugggacgaucacugccaauuuucaagaccaucucccauugguuaccuugggcuccucucacaaagaaccagagacaucuacauuagcaggagacuucugggcacauucacauggacacugucagauucugaagguaaggauacaccagggggguacugucugaccagauggaugcuaauugaagcugaacuuaaauguuucggcaacacagcuguagcuaaauguaaugagaagcaugaugaagaauucugugacaugcugaggcuauuugauuucaacaaacaagcuauccaaagguuaaagacugaagcacaaaugaacauucaguugaucaacaaggcugugaacgcuuuaauaaaugaucaauugauaaugaaaaaccaucugcgggauaucauggggauuccauauuguaacuacagcaaguacugguaucucaacaacacagccacugggaaaacaucacugccuagaugcuggcuugugucaaauggcucauaucuaaacgagacccacuucucugaugacauugaacaacaagcugacaacaugaucacugagauguugcaaaaggaguacauggagagacagggaaagacaccauuaggucuggucgaccucuuuguguucagcacaaguuuuuaucucauuaguaucuuccuucaccuagucaaaauaccaacucauagacacauugugggcaaaccguguccuaaaccucacagguugaaucauauaggcauaugcuccuguggacucuauaaacaaccugguguaccuguaaaauggaagagauaa

SEQ ID NO: 458 - RNA, 1473 nt, Artificial Sequence
  derived and/or modified CDS sequence (wt) from Lassa virus__AIT17404__GPC
augggacaaaucauaacauuuuuccaggaaguaccucaugucauagaggaagugaugaacauuguccugauugcucucagccuucuggcaauacugaaggggaucuacaauguugccaccuguggccuauuuggacugguguccuuucuccucuuaugugggagaucaugcucaacaacuuauaaggguguuuaugagcuacaaacucuagagcuggacauggcaagccuuaauaugacaaugccccuaucuugcacaaagaacaacagucaccauuacaucauggucggaaaugagacuggcuuggagcugacuuuaacaaauacaaguauuaucaaccacaaguuuuguaaccuuucugaugcacauaaaaagaaucucuaugaccaugcuuuaaugaguaucaucucaaccuuccacuuaucuauuccuaauuuuaaucaguaugaagcaaugaguugugacuucaauggggggaagauaaguguucaguacaaccuuagccacgcuuaugcuguagaugcagccaaucacugugggacuaucgccaauggcguucuucagacuuuuaugaggauggcuugggguggcaguuacauagcacuugauuccggaaaggggaguugggauuguauaaugacuuccuaccaauauuugauaauccagaacaccacuugggaagaucacugccaguuuucucgcccauccccuaucgguuaucuggggcuacugucacaaaggaccagagacauuuacaucagucgaagacuucuugggacuuuuacuuggacucucucugauucugaagguaaugaaacaccggguggguacugucuaacaagauggaugcugauugaggccgaguugaagugcuuugggaacacagcaguugcgaaaugcaaugagaaacaugaugaagaguuuugugacauguuaagacuguuugauuucaacaaacaagcuauaaggaggcuaaagacagaagcacagaugaguauccaacugauaaacaaagcagugaaugcauugaucaaugaccagcuuauuaugaagaaucacuugagagauaucaugggaauuccuuacugcaauuacagcaaguacugguaucuaaaucacacuguaacagggaagacaucguugccaaggugcuggcuugugucaaaugguuccuaccugaaugagacacauuuuucugaugacauugaacaacaggcagacaacaugauaacagaacuguugcaaaaggaguacauggacaggcaagggaaaacacccuuaggguuaguagaucuuuuugucuucagcaccagcuuuuaucucauuagcaucuuccuccaccugaucaaaaucccaacccacagacauaucacagggaaacccugcccuaaaccacacagacuuaaccacaugggcauaugcucauguggucuauacaaacauccugguguaccagucaaguggaaaagauag

SEQ ID NO: 459 - RNA, 1473 nt, Artificial Sequence
  derived and/or modified CDS sequence (wt) from Lassa virus__AIT17408__GPC
augggacaaaucauaacauuuuuccaggaagugccucaugucauagaagaagugaugaacauuguccugauugcucucagccuucuggcaauauugaaagggaucuacaauguugcuaccuguggccucuuuggauugguguccuuccuucucuuauguggaagaucaugcucaacaacuuacaaagguguuuaugaauuacaaacucuagagcuagacauggcaagccuuaauaugacaaugcccuuaucuugcacaaagaauaacagccaccauuacaucauggucggaaaugagacugguuuagagcugacucuaacaaauacaaguaucaucaaccacaaguucuguaaccuuucugaugcacauaaaaagaaucuuuaugaccaugcuuuaaugaguaucaucucaaccuuccacuuauccauucccaacuucaaucaguaugaagcaaugaguugugacuucaauggggggaagauaaguguucaguacaaccuuagccacacuuaugcuguagaugcagcuaaccacugugggacuguugcuaauggcguucuccagacuuucaugaggauggcuugggguggcaguuacauagcacuugacuccgggaaagggagcugggauugcauaaugacuuccuaccaauaucugauaauccagaacaccacuugggaagaucacugccaguuuucucgcccaucccccaucgguuaucuggggcugcugucacaaaggaccagggacauuuacaucagucgaagacuccuugggacuuuuacuuggacccucucugauucugaaggcaaugaaacaccggguggguauugucuaacaagauggaugcugauugaggccgaauugaagugcuuugggaacacagcaguugcgaaaugcaaugagaaacaugaugaggaguuuugugacauguuaagauuguuugacuuuaacaaacaagcuauaaggaggcugaagacagaagcgcagaugaguauccaacugauaaacaaagcagugaacgcacugaucaaugaccagcugauuaugaagaaucauuuaagagauaucaugggaauuccuuacugcaauuacagcaaguauugguauuuaaaucacacuguaacagggaagacaucguugccaagaugcuggcuugugucgaaugguuccuaccugaaugagacacauuuuucugaugacauugaacaacaagcagacaacaugauaacagaacugcugcagaaggaguacauggacaggcaaggaaaaacacccuuaggguuaguagaucuuuuugucuucagcaccaguuuuuaucucauuagcaucuuucuccaccuggucaaaaucccaacucacagacaugucauaggaaaacccugcccuaaaccacacagacucaaccacaugggcauaugcucauguggucuguacaaacauccuggugugccagucaaauggaaaagauag

SEQ ID NO: 460 - RNA, 1473 nt, Artificial Sequence
  derived and/or modified CDS sequence (wt) from Lassa virus__AIT17412__GPC
auggggcaaaucauaacauuuuuccaggaagugccucaugucauugaggaggugaugaacauugucuuaauugcucucagccuucuagcaauacuaaaagggauuuacaauguugcuaccuguggccucuuuggguuggugucuuuucuucucuuauguggaaggucaugcucaacaacuuacaaggguguuuaugagcuucaaacucuggagcuggauauggcaagccuuaauaugacaaugcccuuauccugcacgaagaacaacagccaccacuacaucaugguuggaaaugagacuggcuuggagcugacuuuaacaaacacaaguaucauuaaccacaaguucugcaaccuuucugaugcacauaaaaagaaucucuaugaccaugcuuuaaugagcaucaucucaaccuuccaccuaucuaucccuaacuuuaaucaguaugaagcaaugaguugugacuucaauggaggaaagauaaguguucaguacaaccucagccaugcuuaugcuguggaugcagcuaaccauugugggaccauugccaauggaguccuucaaacuuuuaugaggauggccugggguggcaguuacauagcacuugauucuggaaaggggaguugggauuguauaaugacguccuaccaauauuugauaauccaaaacaccaguugggaagaucacugccaguuuucucgcccgucccccaucgguuaucuggggcuacugucacaaagaaccagggacauuuacaucagccgaaggcuccuuggaacuuuuacuuggacucucucugacucugagggcaaugaaacaccggguggguacuguuuaacaagauggauguugauugaggccgaauuaaagugcuuugggaacacagcaguugcgaaaugcaaugagaaacaugaugaagaguuuugugacauguuaagauuguuugacuuuaacaaacaggcuauaaggaggcuaaagacagaagcacagaugaguauccaacuaauaaacaaagcagugaacgcacugaucaaugaccagcucauuaugaagaaucauuuaagagauaucaugggaauuccuuacugcaauuacagcaaguauugguauuuaaaccacacuguaacagggaagacaucguugccaagaugcuggcuuguaucaaaugguuccuaccugaaugaaacacauuuuucugaugacauugagcaacaagcagacaacaugauaacagaauuguuacagaaagaguacauugacaggcaagggaaaacaccuuuaggguugguggaucuuuuugucuucagcacuagcuucuaccuuauuagcaucuuccuccaccuggucaaaaucccaacccacagacaugucauagggaaacccugccccaagccacacagacucaaccacaugggcauaugcucauguggucuguacaaacauccugguguaccagucaaguggaaaagauag

SEQ ID NO: 461 - RNA, 1473 nt, Artificial Sequence
  derived and/or modified CDS sequence (wt) from Lassa virus__AIT17416__GPC
auggggcaaaucauaacguuuuuccaggaagugccucaugucauugaggaggugaugaacauugucuuaauugcucucagccuucuagcaauacuaaaagggauuuacaauguugcuaccuguggccucuuuggguugguguccuuucuucuuuuauguggaaggucaugcucaacaacuuacaaggguguuuaugagcuucaaacucuggagcuggauauggcaagccuuaauaugacaaugcccuuauccugcacgaagaacaacagccaccacuacaucaugguuggaaaugagacuggcuuggagcugacuuuaacaaacacaaguaucaucaaccacaaguucugcaaccuuucugaugcacauagaaagaaucucuaugaccaugcuuuaaugagcaucaucucaaccuuccaccuauccaucccuaacuuuaaucaguaugaagcaaugaguugugacuucaauggaggaaagauaaguguucaguauaaccucagccaugcuuaugcuguggaugcagcuaaccauugugggaccauugccaacggaguccuucaaacuuuuaugaggauggccugggguggcaguuacauagcacuugauucuggaaaggggaguugggauuguauaaugacguccuaccaauauuugauaauccaaaacaccaguugggaagaucacugccaguuuucucgcccguccccuaucgguuaucuggggcugcugucacaaagaaccagggacauuuacaucagccgaaggcuccuuggaacuuuuacuuggacucucucugacucugagggcaaugaaacaccggguggguauuguuuaacaagauggaugcugauugaggccgaauuaaagugcuuugggaacacagcaguugcgaaaugcaaugagaaacaugaugaagaguuuugugacauguuaagguuguuugacuuuaacaaacaggcuauaaggaggcuaaagacagaagcacagaugaguauccaacuaauaaacaaagcagugaacgcauugaucaaugaccagcucauuaugaagaaucauuuaagagauaucaugggaauuccuuacugcaauuacagcaaguauugguacuuaaaccacacugugacagggaagacaucguugccaagaugcuggcuuguaucaaaugguuccuaccugaaugaaacacauuuuucugaugacauugagcaacaagcagacaacaugauaacagaauuguuacagaaagaguacauugacaggcaagggaaaacacccuuaggguugguggaucuuuuugucuucagcacuagcuucuaccuuauuagcaucuuccuccaccuggucaaaaucccaacccacagacaugucauagggaaacccugccccaagccacacagacucaaccacaugggcauaugcucauguggucuguacaaacauccugguguaccagucaaguggaaaagauag

SEQ ID NO: 462 - RNA, 1473 nt, Artificial Sequence
  derived and/or modified CDS sequence (wt) from Lassa virus__AIT17420__GPC
augggacaaaucauaacauuuuuccaggaaguaccccaugucauagaggaagugaugaacauuguccugauugcucucagccuucuggcaauacugaaggggaucuacaauguugccaccuguggccuauuuggacugguguccuuucuccucuuauguggaagaucaugcucaacaacuuauaaggguguuuaugagcuacaaacucuagagcuggacauggcaagccuuaauaugacaaugccccuaucuugcacaaagaacaacagucaccauuacaucauggucggaaaugagacuggcuuggagcugacuuuaacaaauacaaguauuaucaaccacaaguuuuguaaccuuucugaugcacauaaaaagaaucucuaugaccaugcucuaaugaguaucaucucaaccuuccacuugucuauuccuaauuuuaaucaguaugaagcaaugaguugugacuucaauggggggaagauaaguguucaguacaaccuuagccacacuuaugcuguagaugcagccaaucacugugggacuaucgccaauggcguucuucagacuuuuaugaggauggcuugggguggcaguuauauagcacuugauuccggaaaggggaguugggauuguauaaugacuuccuaccaauauuugauaauccagaacaccacuugggaagaucacugccaguuuucucgcccauccccuaucgguuaucuggggcuacugucacaaaggaccagagacauuuacaucagucgaagacuucuugggacuuuuacuuggacucucucugauucugaagguaaugaaacaccggguggguacugucuaacaagauggaugcugauugaggccgaguugaagugcuuugggaacacagcaguugcgaaaugcaaugagaaacaugaugaagaguuuugugacauguuaagacuguuugauuucaauaaacaagcuauaaggaggcuaaaaacagaagcacagaugaguauccaacugauaaacaaagcagugaaugcacugaucaaugaccagcuuauuaugaagaaucacuugagagauaucaugggaauuccuuacugcaauuacagcaaguacugguaucuaaaucacacuguaacagggaagacaucguugccaaggugcuggcuugugucaaaugguuccuaccugaaugagacacauuuuucugaugacauugaacaacaggcagacaacaugauaacagaacuguugcaaaaggaguacauggacaggcaagggaaaacacccuuaggguuaguagaucuuuuugucuucagcaccagcuuuuaucucauuagcaucuuccuccaccugaucaaaaucccaacccacagacauaucacagggaaacccugcccuaaaccacacagacuuaaccacaugggcauaugcucauguggucuauacaaacauccugguguaccagucaaguggaaaagauag

SEQ ID NO: 463 - RNA, 1473 nt, Artificial Sequence
  derived and/or modified CDS sequence (wt) from Lassa virus__AIT17424__GPC
augggacaaaucauaacauuuuuccaggaaguaccccaugucauagaggaagugaugaacauuguccugaucgcucucagccuucuggcaauauugaaagggaucuacaauguugcuaccuguggccucuuuggauugguguccuuucuucucuuauguggaagaucauguucaacaacuuacaaggguguuuaugagcuacaaacucuagagcuagacaugacaaaccucaauaugacaaugcccuuaucuugcacgaaaaacaacagccaccauuacaucauggucggaaaugagacuggucuggagcugacuuugacaaauacaagcaucaucaaccacaaguuuuguaaccucucugaugcacauaaaaagaaucuuuauaaccaugcuuuaaugagcauuauuucaacuuuccacuuauccauucccaacuuuaaucaguaugaggcaaugaguugugacuucaauggagggaagauaaguguccaguacaaccuuagccacgcuuaugcuguagaugcagcuaaccacugugggaccauugccaauggcgugcuucagacuuuuaugaggauggcuugggguggcaguuacauagcacuugauuccggaaaggggaguugggauuguauaaugacuuccuaccaauauuugauaauccaaaacaccacuugggaagaucacugucaguuuucucgcccauccccuauugguuaucugggguuacugucacaaaggaccagggacauuuacaucagucgaagacuucuugggacuuuuacuuggacucucucugauucugaagguaaugaaacaccagguggguauugucuaacaagauggaugcugauugaggccgaguugaagugcuuugggaacacagcaguugcgaaauguaaugagaaacaugaugaagaguuuugugacauguugagauuguuugacuuuaacaaacaagcuauaaggaggcugaagacagaggcacagacgaauauccaacugauaaauaaagcagugaacgcacugaucaaugaccagcugaucaugaagaaucauuuaagagauaucaugggaauuccuuacugcaauuacagcaaguauugguacuuaaaucacacugugacagggaagacaucguugccaagaugcuggcuugugucaaaugguuccuacuugaaugagacacacuuuucugaugacauugaacaacaagcagacaauaugauaacagaacuguugcagaaggaguacauggacaggcaagggaaaacacccuuaggguugguagaucuuuuugucuucagcaccagcuuuuaucucauuagcaucuuccuccaccugguuaaaaucccaacccacagacacaucauagggaaaccuugcccuaaaccacacagacucaaccacaugggcauaugcucauguggucuguacaaacauccugguguaccagucaaguggaagagauag

SEQ ID NO: 464 - RNA, 1473 nt, Artificial Sequence
  derived and/or modified CDS sequence (wt) from Lassa virus__AIT17428__GPC
augggacaaaucauaacauuuuuccaggaaguaccucaugucauagaggaagugaugaacauuguccugauugcucucagccuucuggcaauacugaaagggaucuacaauguugcuaccuguggccucuuuggauugguguccuuucuccucuuaugugggagaucaugcucaacaacuuacaaggguguuuaugagcuacaaacccuagagcuagacauggcgagccucaacaugacaaugcccuugucuugcacgaagaacaacucccaccacuacaucauggucggaaaugagaccggcuuggaguugacuuuaacaaauacaagcauuaucaaccacaaguuuuguaaccuuucugaugcacauaaaaagaaccuuuaugaccaugcuuugaugaguauuaucucaaccuuccacuuauccauuccuaacuuuaaccaguaugaggcaaugaguugugacuucaaugggggaaagauaaguguucaguacaaccuuagccacacuuaugcuguagaugcagcuaaccacugugggaccauugccaauggcguucuucagacuuuuaugaggauggcuugggguggcaguuauauagcacuugauuccggaaaggggagcugggauugcauaaugaccuccuaccaauauuugauaauccaaaacaccacuugggaagaucacugccaguuuucucgcccaucccccaucgguuaccuggggcuacugucacaaaggaccagggacauuuacaucagucgaagacuucuugggacuuuuacuuggacucucucugacucugaagguaaugaaacaccggguggguauugucuaacaagauggaugcugauugcggccgauuugaagugcuuugggaacacagcaguugcaaaaugcaaugagaagcaugaugaggaguuuugugacauguuaagauuguuugacuuuaacaaacaagcuauagagaggcugaagacagaagcacagaugaguauccagcugauaaacaaagcaguaaacgcacugaucaaugaccagcugaucaugaagaaucauuugagagauaucaugggaauuccuuacugcaauuacagcaaguauugguaucuaaaucacacuguaacagggaggacaucguugccaagaugcuggcuugugucaaaugguuccuaccugaaugagacacauuuuucugaugacauugaacaacaagcagacaacaugauaacagaacuguugcaaaaggaguacauggacaggcaagggaaaacaccuuuaggguuaguagaucuuuuugucuucagcaccagcuuuuaccucauuagcaucuuccuccaccugguuagaaucccaacccacagacaugucauagggaaacccugccccaaaccacacagacuuaaccauaugggcauaugcucauguggucuguacaaacauccuggugugccagucaaguggaaaagauag

SEQ ID NO: 465 - RNA, 1473 nt, Artificial Sequence
  derived and/or modified CDS sequence (wt) from Lassa virus__AIT17430__GPC
augggacaaaucauaacauuuuuccaggagguaccucaugucauagaggaagugaugaacauugucuugauugcucucagccuucuggcaauacugaaagggaucuacaauguugccaccuguggccucuuuggauugguguccuuucuccucuuauguggaagaucaugcucaacaacuuauaaggguguuuaugagcuacaaacucuagagcuagacauggcaagucuuaauaugacaaugcccuuaucuugcacaaagaacaacagccaccauuacaucauggucggaaaugagacuggcuuggaguugacuuuaacaaauacaaguauuaucaaccacaaguuuuguaaccuuucugaugcacauaaaaagaaucucuaugaccaugcuuuaaugaguaucaucucaaccuuccacuuaucuauuccuaauuucaaucaguaugaagcaaugagcugugacuucaauggggggaggauaaguguucaguacaaccugagccacacuuaugcuguagaugcagccaagcacugugggacuaucgcuaauggcguucuucagacuuuuaugaggauggcuugggguggcaguuacauagcacuugauuccggaaaggggaguugggacuguauaaugacuuccuaccaauauuugauaauccaaaacaccacuugggaagaucacugccaguuuucucgcccauccccuauugguuaucuggggcuacuaucacaaaggaccagagacauuuauauuagucgaagacuucuugggacuuuuacuuggacucucucugauucugaggguaaugagacaccggguggguauugucuaacaagauggaugcugauugaggccgaguugaaguguuuugggaacacagcaguugcgaaaugcaaugagaaacaugaugaagaguucugugacauguugagacuguuugacuuuaauaaacaagcuauaaggaggcugaagacagaagcacagaugagcauccaacugauaaacaaagcaguaaacgcacugaucaaugaccagcuuauuaugaagaaucacuugagggauaucaugggaauuccuuacugcaauuacagcaaguacugguaucuaaaucauacuguaacagggaagacaucguugccaaggugcuggcuugugucaaaugguuccuaccugaaugagacacauuucucugaugacauugaacaacaagcagacaacaugauaacagaacuauugcaaaaggaguacauagacaggcaagggaaaacacccuuaggguuaguagaucuuuuugucuuuagcaccagcuuuuaucucauuagcaucuuccuccaccuggucaaaaucccaacccacagacauguuauagggaaaccuugcccuaaaccacacagacucaaccacaugggcauaugcucauguggucuuuacaaacauccugguguuccagucaaguggaaaagauag

SEQ ID NO: 466 - RNA, 1473 nt, Artificial Sequence
  derived and/or modified CDS sequence (wt) from Lassa virus__AIT17438__GPC
augggacagaucauaacauuuuuccaggaaguaccucaugucauagaggaggugaugaacauuguucugauugcucucagccuucuggcaauacugaaggggaucuacaauguugcuaccuguggccucuuuggauuggugucuuuucuccuccuguguggaagaucaugcucaacaaccuacaaggguguuuaugagcuacaaacucuagagcuagacauggcaaaccuuaacaugacaaugccccugucuugcacgaagaacaacucccaccauuacaucaggguuggaaaugagacuggcuuggagcugaccuuaacaaauacaagcauuaucagccacaaguuuuguaaccuuucugaugcacauaaaaagaaucuuuaugaccaugcuuugaugaguaucaucucaaccuuccacuuauccauuccuaacuuuaaucaguaugaagcaaugaguugugacuucaaugggggaaagauaaguguucaguauaaccuuagucacaccuaugcuguggaugcagccaaccacugugggaccauugccaauggcguucuucagacuuuuaugaggauggcuugggguggcaguuauauagcacuugauuccggaaaggggagcugggauugcauaaugacuuccuaccaauauuugauaauccaaaacacuacuugggaagaucacugccaguuuucucgcccaucccccaucggcuaucuggggcugcugucacaaaggaccagggacauuuacaucagucgaagacuucuugggacuuuuacuuggacucucuccgacucugaaggcaaagaaacaccggguggguauugucuaacaagauggaugcugauugaggcugaguugaagugcuuugggaacacagcagucgcaaagugcaaugagaaacaugaugaagaguuuugugacauguugagauuauuugacuucaacaaacaagccauaaggagacugaaaacagaggcacaaaugaauauccaacugauaaacaaagcagugaacgcacugauuaaugaccagcugaucaugaagaaucacuugagggauaucaugggaauuccuuauuguaauuacagcaaauauugguaucuaaaucacacuguaacagggaagacaucguugccaagaugcuggcuugugucaaauggcuccuaccugaaugagacacauuuuucugaugacauugagcagcaagcagacaacaugauaacagaacuguugcaaaaggaguacauagacaggcaaggaaaaacacccuuaggguuaguagaucuuuuugucuucagcaccagcuucuaucucauuagcaucuuccuccacuugguuaaaaucccaacccacagacaugucauagggaaacccugccccaaaccacacagacucaaccaaaugggcauaugcucaugugguuuguacaaacaaccuggugugccagucaaguggaaaagauag

SEQ ID NO: 467 - RNA, 1473 nt, Artificial Sequence
  derived and/or modified CDS sequence (wt) from Lassa virus__AIT17442__GPC
auggggcaaaucauaacauuuuuccaggaagugccucaugucauugaggaggugaugaacauugucuuaauugcucucagccuucuagcaauacuaaaagggauuuacaauguugcuaccuguggccucuuuggguugguguccuuucuucucuuauguggaaggucaugcucaacaacuuacaaggguguuuaugagcuucaaacucuggagcuggauauggcaagccuuaauaugacaaugcccuuauccugcacgaagaacaacagccaccacuacaucaugguuggaaaugagacuggcuuggagcugacuuuaacaaacacaaguaucaucaaccacaaguuuugcaaccuuucugaugcacauagaaagaaucucuaugaccaugcuuuaaugagcaucaucucaaccuuccaccuauccaucccuaacuuuaaucaguaugaagcaaugaguugugacuucaauggggggaagauaaguguucaguacaaccucagccaugcuuaugcuguggaugcagcuaaccauugugggaccauugccaauggaguccuucaaacuuuuaugaggauggcuugggguggcaguuacauagcacuugauucuggaaaggggaguugggauuguauaaugacguccuaccaauauuugauaauccaaaacaccaguugggaagaucacugccaguuuucucgcccguccccuaucgguuaucuggggcuacuuucacaaagaaccagggacauuuacaucagccgaagacuccuuggaacuuuuacuuggacucucucugauucugagggcaaugaaacaccggguggauauuguuuaacaagauggaugcugauugaagccgaauugaagugcuuugggaacacagcaguugcgaaaugcaaugagaaacaugaugaagaguuuugugacauguuaagguuguuugacuuuaauaaacaggcuauaaggaggcuaaagacagaagcacagaugaguauccaacuaauaaacaaagcagugaaugcauugaucaaugaccagcucauuaugaagaaucauuuaagagauaucaugggaauuccuuacugcaauuacagcaaguauugguacuuaaaccacacuguaacagggaagacaucguugccaagguguuggcuuguaucaaaugguuccuaccugaaugaaacacauuuuucugaugacauugagcaacaagcagacaacaugauaacagaauuguuacagaaagaguacauugauaggcaagggaaaacacccuuaggguugguggaucuuuuugucuucagcacuagcuucuaccuuauuagcaucuuccuccaccugguuaaaaucccaacccacagacaugucauagggaaacccugccccaagccacacagaaucaaccacaugggcauaugcucauguggucuguacaaacauccugguguaccagucaaguggaaaagauag

SEQ ID NO: 468 - RNA, 1473 nt, Artificial Sequence
  derived and/or modified CDS sequence (wt) from Lassa virus__AIT17446__GPC
auggggcaaaucauaacauuuuuccaggaagugccucaugucauagaagaagugaugaacauuguccugauugcccucagccuucuggcaauauugaaggggaucuacaauguugcuaccuguggccucuuuggauugguuuccuuucuucucuuauguggaagaucaugcucaacaacuuacaaagguguuuaugagcuacaaacucuagagcuagacauggcaagccuuaauaugacaaugcccuuaucuugcacaaagaauaacagccaccauuacaucauggucggaaaugagacuggcuuggagcugaccuuaacaaauacaaguaucauuaaccacaaguuuuguaaccuuucugaugcacauaaaaagaaucuuuacgaccaugcuuuaaugaguaucaucucaacuuuccauuuauccauuccuaauuuuaaucaguaugaagcaaugaguugugacuucaauggggggaagauaaguguucaguacaaccuuagccacacuuaugcuguagaugcagccagccacugugggaccguugccaauggcguucuucagacauucaugaggauggcuugggguggcaguuacauagcacuugauucugggaaagggaguugggauuguauaaugacuuccuaccaauauuugauaauccagaacaccaccugggaagaccacugccaguuuucucgcccaucccccaucgguuaucuggggcuacugucacaaaggaccagggacauuuacaucagucgaagacuccuugggacuuuuacuuggacccucucugauucugaaggcaaugaaacaccggguggguauugucuaacaagauggaugcugauugaggcugaguugaagugcuuugggaacacagcaguugcgaagugcaaugagaaacaugaugaagaguuuugugacauguuaagauuguuugauuuuaacaaacaagcuauaaggaggcugaagacagaagcacagaugaguauccaacugauaaacaaagcagugaacgcacugaucaacgaccaacugauuaugaagaaucauuuaagagacaucaugggaauuccuuacuguaauuacagcaaauauugguauuuaaaucacacuguaacagggaagacaucgcugccaagaugcuggcuugugucaaaugguuccuaccugaaugagacacauuuuucugaugacauugaacaacaagcagacaacaugauaacagaacuguugcagaaggaguacauggacaggcaagggaaaacacccuuaggguuaguagaucuuuuugucuucagcaccaguuuuuaucucauuagcauuuuccuccaccugguuaaaaucccaacucacagacaugucauagggaaacccugccccaaaccacacagacucaaccacaugggcauaugcucauguggucuguacaaacauccugguguaccagucaaauggaaaagauag

SEQ ID NO: 469 - RNA, 1473 nt, Artificial Sequence
  derived and/or modified CDS sequence (wt) from Lassa virus__AIT17450__GPC
augggacaaaucauaacauuuuuccaggaaguaccucauguuauagaggaagugaugaacauuguccugauugcucucagccuucuggcaauauugaaagggaucuacaauguugcuacuuguggccucuuuggauuggugucuuuucuccucuuauguggaagaucaugcucaacaacuuacaaggguguuuaugagcuacaaacucuagaguuagacauggcaagccuuaauaugacaaugcccuuaucuugcacgaagaacaacagccaccauuacaucauggucggaaaugagacuggcuuggagcugacuuuaacaaauacaaguauuaucaaccacaaguuuuguaaccuuucugaugcacauaaaaagaaucuuuaugaccaugcuuuaaugagcaucaucucaaccuuccacuuauccauuccuaacuuuaaucaguaugaagcaaugaguugugacuucaauggagggaagauaaguguucaguacaaccuuagccacacuuaugcuguagaugcagccaaccacugugggacuaucgccaauggcguucuucagaccuuuaugaggauggccugggguggcaguuauauagcacuugauuccggaaaggggaguugggacugcauaaugacuuccuaccaauauuugauaauccaaaacaccacuugggaagaucacugccaguuuucccgcccauccccuaucgguuauuuggggcuacugucacaaaggaccagggacauuuacaucagucggagacuucuugggacuuuuacuuggacucucucugauucugaaggcaaugaaacaccgggcggguauugucugacaagauggaugcugauugaggccgaguugaagugcuucgggaacacagcaguugcgaaaugcaaugagaaacaugaugaagaguuuugugacauguuaagauuguuugacuuuaacaagcaagcuauaaggaggcugaagacagaagcacagaugaguauccaacugauaaacaaagcagugaacgcacugaucaaugaccagcugauuaugaagaaucauuugagagauaucaugggaauuccuuacugcaauuacagcaaguacugguaucuaaaucacacugugacagggaagacaucguugccgaggugcuggcuugugucaaaugguuccuaccugaaugaaacacauuuuucugaugacauugaacaacaagcagacaacaugauaacagaacuguugcaaaaggaguacauagacaggcaagggaaaacacccuuaggguuaguagaucucuuugucuucagcaccagcuuuuaucucauuagcaucuuccuccaccuggucaagaucccaacccacagacauaucauagggaaacccugcccuaaaccacacagacucaaccacaugggcauaugcucauguggucuauacaaacauccugguguaccaguuaaguggaaaagauag

SEQ ID NO: 470 - RNA, 1473 nt, Artificial Sequence
  derived and/or modified CDS sequence (wt) from Lassa virus__AIT17454__GPC
augggacaaaucauaacauuuuuucaggaaguaccucaugucauagaggaagugaugaacauuguccugauugcuuucagccuucuggcaauacugaaagggaucuacaauguugcuaccuguggccucuuuggauuggugucuuuucuccucuuguguggaaggucaugcucaacaacuuacaaagguguuuaugagcuacaaacucuggagcuagacauggcaagccuuaauaugacaaugcccuuaucuugcacaaagaacaacagccaucauuacaucauggucggaaaugagacuggcuuagagcugacuuuaacaaauacaagcaucaucaaccacaaguuuuguaaccuuucugaugcacauaaaaggaaucuuuaugaccaugcuuuaaugaguaucaucucaaccuuccacuuauccauucccaacuuuaaucaguaugaggcaaugaguugugauuucaaugggggaaagauaaguguucaguacaaucuuagucacacuuaugcuguagaugcagcugggcacuguggaaccauugccaauggcguucuucagacuuuuaugaggauggcuugggguggcaguuacauagcacuugauucuggaaaggggaguugggauuguauaaugaccuccuaccaauauuugauaauccaaaacaccacuugggaagaucacugccaguuuucccgcccauccccuauagguuaucuagggcuacugucacaaagaacuagggacauuuacaucagucgaagacuucuugggacuuuuacuuggacucucucugauucugaagguaaugaaacaccggguggguauugucugacaagauggaugcugauugaggcugagcugaaaugcuuugggaacacagcaguugcgaaaugcaaugagaaacaugaugaagaguuuugugacauguuaagguuguuugacuuuaacaaacaagcuauaaggaggcuaaagacagaggcacagaugaguauccaacugauaaacaaagcagugaaugcacugaucaaugaccagcuaaucaugaagaaucauuugagagauaucaugggaauuccuuacugcaauuacagcaaguauugguaucuaaaucacacuauaacagggaagacaucguugccaagaugcuggcucgugucaaauggcuccuaccugaaugaaacgcauuuuucugaugacauugaacaacaagcagacaacaugauaacagaacuguugcagaaggaguacauggacaggcaagggaaaacacccuuaggguuaguagaucuuuuuguuuucagcaccagcuuuuaucucauuagcaucuuccuccaccugguuaaaaucccaacccauaggcacaucauaggaaaacccugcccuaaaccacacagacucaaccacaugggcauaugcucauguggucuguacaaacauccugguguaccggucagauggaaaagauag

SEQ ID NO: 471 - RNA, 1473 nt, Artificial Sequence
  derived and/or modified CDS sequence (wt) from Lassa virus__AIT17458__GPC
augggacaaaucauaacauuuuuccaggaaguaccccaugucauagaagaagugaugaacauuguccugauugcucucagccuucuggcaauacugaaagggaucuacaauguugcuaccuguggccucuuuggauugguguccuuccuccucuuguguggaagaucaugcucaacaacuuacaaggguguuuaugagcuacaaacucuagagcuagacauggcaagccuuaauaugacaaugcccuuaucuugcacgaagaacaacucccaccauuacaucauggucggaaaugagacuggcuuggagcugacuuugacaaauacaagcauuaucaaccacaaguuuuguaaccuuucugaugcgcauaaaaagaaucuuuaugaccaugcuuugaugaguaucaucucaaccuuccauuuauccauuccuaacuuuaaucaguaugaggcaaugaguugugauuucaaugggggaaagauaaguguucaguacaaccuuagccacacuuaugcuauagaugcagccaaccacugugggaccauugccaauggcguccuucagacuuuuaugagaauggcuugggguggcaguuacauagcacuugauuccggaaagggaagcugggauugcauaaugacuaccuaccaauauuugauaauccaaaacaccacuugggaagaucacugccaguuuucucgcccaucccccaucgguuaucuggggcuacuaucacaaagaaccagagacauuuacauuagucgaagacuccuugggacuuucacuuggacucucucugacucugaagguaaugaaacaccggguggguauugucuaacaagauggaugcugauugaggccgaguugaagugcuuuggaaacacagcaguugcaaaaugcaaugagaaacaugaugaagaguuuugugacauguuaagauuguuugacuuuaacaaacaagcuauaaggaggcugaagacagaagcacagaugagcauccaacugauaaauaaagcggugaacgcacugaucaaugaccagcugaucaugaagaaucauuugagagacaucaugggaauuccuuacugcaauuacagcaaguauugguaucuaaaccacacuguaacagggaagacaucauugccaagaugcuggcuugugucaaaugguuccuaccugaaugagacacacuucucugaugacauugaacaacaagcagacaacaugauaacagaauuguugcaaaaggaguauauggacaggcaagggaaaacacccuuaggguuaguagaucuuuuugucuucagcacuagcuucuaucucaucagcaucuuccuccaccugguuaaaaucccaacccacagacaugucauagggaaacccugcccuaaaccacauagacucaaccacaugggcauaugcucauguggucuguacaaacauccuggcgugccagucaaguggaaaagauag

SEQ ID NO: 472 - RNA, 1473 nt, Artificial Sequence
  derived and/or modified CDS sequence (wt) from Lassa virus__AIT17462__GPC
augggacaaauuauaacauucuuccaggaagugccucaugucauagaggaagugaugaacauugucuugauugcucucagccuucuggcaauacugaaagggaucuacaauguugccaccuguggccucuuugggcugguguccuuucuucucuuauguggaagaucauguucaacaacuuacaaggguguuuaugagcuacaaacucuggagcuggacauggcaagccuuaauaugacaaugcccuuaucuugcacgaagaacaacagccaccauuacaucauggucggaaaugaaacuggcuuggagcugacuuuaacaaacacaaguaucaucaaccacaaguucuguaaccuuucugacgcacauaaaaagaaccuuuaugaccaugcuuuaaugaguauuaucucaaccuuccacuuguccauucccaacuuuaaccaguaugaagcaaugaguugugacuucaaugggggaaagauaagugugcaguacaaccucagccaugcuuaugcuguggacgcagcuaaccacugugggaccauugccaauggaguucuucagacuuuuaugaggauggcuugggguggcaguuacauagcacuugauuccggaaaggggaguugggauuguauaaugacuuccuaccaguaucuaauaauccaaaacaccaccugggaagaucacugccaguuuucucguccaucccccaucgguuaucuggggcugcugucacaaagaaccagggacauuuacaucagucgaagacuccuuggaacuuuuacuuggacucucucugacucugaagguaacgaaacaccagguggauauuguuuaacaagauggaugcugauugaggccgaguugaagugcuuugggaacacagcaguugcgaaaugcaaugagaaacaugaugaagaguuuugugauauguugagacuguuugacuuuaacaaacaagcuauaaggaggcuaaagacagaagcacagaugagcauucaacuaauaaacaaagcagugaacgcacugaucaaugaccagcuaauuaugaagaaucauuuaagagauauuaugggaauuccuuacugcaauuacagcaaguauugguauuuaaaucacacuguaacagggaagacaucauugccaaaaugcuggcuugugucaaaugguuccuaccugaaugagacacauuuuucugaugacauugaacaacaagcagacaacaugauaacagaauuguuacagaaggaguacauagacaggcaagggaaaacacccuuaggguugguggaucucuuuguuuucagcaccagcuuuuaucucauuagcaucuuccuccaccuggucaaaaucccaacccacagacaugucauagggaaacccugcccuaagccacacagacucaaccacaugggcauaugcucauguggucuauacaaacauccuggugugccaguuaaguggaaaagauag

SEQ ID NO: 473 - RNA, 1473 nt, Artificial Sequence
  derived and/or modified CDS sequence (wt) from Lassa virus__AIT17466__GPC
augggacaaaucauaacauuuuuccaggaaguaccucaagucauagaggaagugaugaacauuguccugauugcucucagccuucuggcaauacugaaagggaucuacaauguugcuaccuguggccucuuuggauugguguccuuucuccuacugugcggaagaucaugcucgacaaccuacaagggcguuuaugagcuacaaacccuagagcuagacauggcaagccuuaauaugacaaugcccuuaucuugcacgaagaacaacagccaucauuacaucauggucggaaaugagaccggcuuagagcugacuuuaacaaaccaaaguauuaucaaccacaaguuuuguaaccuuucugaugcacauaaaaagaaucuuuaugaccaugcuuuaaugaguaucaucucaacuuuccacuuauccauucccaacuuuaaucaguaugaagcaaugaguugugacuucaauggaggaaagauaaguguucaguacaaccuuagccacacuuuugcuguagaugcagcuaaccacuguggaaccaucgccaaugguguucuucagacuuuuaugaggauggcuugggguggcaguuacauagcacuugauuccggaagggggaguugggacugcauaaugacuuccuaccaauauuugauaauccaaaacaccacuugggaagaucacugccaauuuucucgcccauccccuaucgguuaucuggggcuacugucacaaaggaccagggauauuuacaucagccgaaggcuucuugggacuuuuacuuggacucucucugauucugaagguaaugaaacaccggguggguauugucuaacaagauggaugcugauugaggccgagcugaaguguuuugggaacacagcaguugcgaagugcaaugagaaacacgaugaagaguuuugugauauguuaagguuguuugacuuuaacaaacaagcuauaaggagacugaagacggaagcacagaugaguauccaacuaauaaacaaagcaguaaacgcacuaaucaaugaccagcugaucaugaagaaucauuugagagauaucaugggaauucccuacugcaauuacagcaaauacugguauuuaaaucauacuauaacagggaagacaucacugccaagaugcuggcuugugucaaaugguuccuaccugaaugagacacauuuuucugaugacauugaacaacaagcagacaacaugauaacagaacuguugcaaaaggaguacauggacagacaagggaaaacacccuuaggguuaguagaucuuuuugucuucagcaccaguuuuuaucucauuagcaucuuccuccaccugguuaaaaucccaacccauagacaugucauagggaaacccugcccuaaaccacacagacucaaccacaugggcauaugcucauguggucuguacaaacauccugguguaccaguuaaguggaaaagauag

SEQ ID NO: 474 - RNA, 1473 nt, Artificial Sequence
  derived and/or modified CDS sequence (wt) from Lassa virus__AIT17470__GPC
auggggcaaaucauaacauuuuuccaggaagugccucaugucauagaggaggugaugaacauugucuugauugcucucagccuucuagcaauacugaaagggaucuacaaugucgccaccuguggccuuuuuggguugguguccuuucuucuccuauguggaagaucaugcucaacaacuuacaaggguguuuaugagcuacaaacucuggaacuggacauggcaagccucaauaugacaaugcccuuauccugcacgaagaauaacagccaccacuacauuaugguuggaaaugagacuggcuuggagcuaacuuuaacaaacacaagcauuaucaaucauaaguuuuguaaccuuucugaugcacauagaaagaaucuuuaugaccaugcuuuaaugaguaucaucucaaccuuucauuuauccauucccaacuuuaaucaguaugaagcaaugaguugugacuuuaaugggggaaagauaaguguucaguacaaccucagccauaccuaugcuguggaugcagcaaaccacugugggaccauugccaaugguguucuacagacuuuuaugaggauggcuugggguggcagcuacauagcacuugauuccggaaagggaagcugggauuguauaaugacuuccuaccaguacuugauaauccaaaacaccacuugggaagaucacugccaguuuucccgcccgucccccaucgguuaucuggggcuacuaucacaaagaacuagagacaucuacaucagucgaagacuucuuggaacuuucacuuggacucuuucugauucugaagguaaugaaacaccagguggguauuguuuaacaagauggaugcugauugaggccgaguugaaaugcuuugggaacacagcaguugcaaaguguaaugagaaacaugaugaagaguuuugugacauguugagauuguuugacuuuaacaaacaagcuauaaggagauugaagacagaagcacagaugagcauccaacugauaaacaaagcagugaacgcauuaauuaaugaccaguugaucaugaagaaccauuuaagagauaucaugggaauuccuuacugcaauuauagcaaguauugguauuuaaaucacacuguaacagggaaaacaucgcugccaagaugcuggcuugugucaaaugguuccuaccuaaaugagacacauuuuucugaugacauugaacaacaagcagacaacaugauaacagaauuguuacaaaaagaguacauagacaggcaagggaaaacaccuuugggguugguagaccuuuuuguuuucagcaccagcuuuuaucucaucagcaucuuccuccaccugguuaaaaucccaacccacagacaugucauagggaaacccuguccuaaaccacacagacucaaccacaugggcauaugcucauguggucuguauaaacaucccggugugccaguuaaguggaagagauag

SEQ ID NO: 475 - RNA, 1473 nt, Artificial Sequence
  derived and/or modified CDS sequence (wt) from Lassa virus__AIT17474__GPC
augggacagaucauaacauuuuuccaggaaguaccucaugucauagaggaagugaugaacauuguccugauugcucucagccuucuggcaauauugaaagggaucuacaauguugcuaccuguggccucuuuggauugguguccuuucuccuccuauguggaaggucaugcucaacaacuuauaaggguguuuaugagcugcaaacucuagagcuagacauggcaagccucaauaugacaaugcccuuaucuugcacgaagaacaacagccaucauuacaucauggucggaaaugaaacuggcuuagagcuaaccuuaacaaauacaaguaucaucaaccacaaguucugcaaccuuucugaugcacauaaaaagaaucucuaugaucaugcucuaaugaguaucaucucaaccuuccacuuguccauucccaacuucaaucaguaugaggcaaugaguugugacuucaauggggggaagauaagcauucaguacaaccuuagccacacuuaugcuguagaugcagcuaaccacugugggaccauugccaauggcguucuucagacuuuuaugaggauggcuugggguggcaguuacauagcacuugauucuggaaaggggaguugggauuguauaaugacuuccuaccaauauuugauaauccaaaacaccacuugggaagaucacugccaguuuucccguccguccccuauagguuaucuggggcuacugucacagaggaccagggacaucuacaucagucgaagacuucuugggacuuuuacuuggacucucucugauucugaagguaaugaaacaccggguggguauugccuaacaagauggaugcugauugaggccgagcugaagugcuuugggaacacagcaguugcgaaaugcaaugagaaacaugaugaagaguuuugugacauguugagguuguuugacuuuaacaaacaagcuauaagaaggcugaagacagaggcacaaaugaguauccaacugauaaacaaagcagugaacgcauugaucaaugaccagcuaaucaugaagaaucauuugagagauauuaugggaauuccuuacugcaauuacagcaaguacugguaucuaaaucacacuauaacagggaagacaucguugccaagaugcuggcuugugucaaaugguuccuaccugaaugaaacacauuuuucugaugacauugaacaacaagcagacaacaugauaacagaacuguugcagaaggaguacauagacaggcaagggaaaacacccuuaggguuaguagaucuuuuugucuucaguacuagcuuuuaucucauuagcaucuuccuccaccugguuaaaaucccaacccacaggcauaucacagggaaacccugcccuaagccacacagacucaaccacaugggcauaugcucauguggucuguacaaacauccuggugugccaguuagauggaaaagauag

SEQ ID NO: 476 - RNA, 1473 nt, Artificial Sequence
  derived and/or modified CDS sequence (wt) from Lassa virus__AIT17478__GPC
augggacaaaucauaacauuuuuccaggaaguaccucaugucauagaggaagugaugaacauugucuugauugcucucagccuucuggcaauacugaaaggaaucuacaauguugcuaccuguggccucuuuggauugguguccuuucuccucuuauguggaagaucaugcucaacaacuuacaaggguguuuaugagcuacaaacccuggaguuggacauggcaagccuuaauaugacaaugcccuuaucuugcacaaagaauaacagccaccauuacaucauggucggaaaugagacuggcuuggagcugacuuuaacaaauacaaguaucaucaaccacaaguuuuguaaccuuucugaugcacauaaaaagaaucuuuaugaucaugcuuugaugaguaucaucucaaccuuccacuuauccauuccuaacuucaaucaguaugaagcaaugaguugugacuuuaauggggggaagauaaguguucaguacaaccuuagccacacuuaugcuguagaugcagccgaccacugugggacuaucgccaauggcguucuucaaacuuuuaugaggauggcuugggguggcaguuacauagcacuugauuccggaaaggggaguugggacuguauaaugacuuccuaccaauauuugauaauccaaaacaccacuugggaagaucacugccaguuuucucgcccauccccuaucgguuaccuggggcuacugucacagaggaccagggacauuuacaucagucgaaggcuucuugggacuuuuacuuggacucucucugauucugaagguaaugaaacaccggguggguauugucuaacaagauggaugcugauugaggccgaguugaagugcuuugggaacacggcaguugcaaaaugcaaugagaaacaugaugaagaguuuugugacauguuaagauuguuugacuuuaacaaacaagccauaagcaggcugaagacagaagcacaaaugaguauccaacugauaaacaaagcagugaacgcauugaucaaugaccagcugauuaugaagaaucauuugagagacaucaugggaauuccuuacugcaauuacagcaaguacugguaucugaaucacacugugacagggaagacaucauugccaaggugcuggcuuguaucaaaugguuccuaccuaaacgaaacacacuuuucugaugacauugaacaacaagcagacaacaugauaacagaaauguugcaaaaggaguacauagacaggcaagggaaaacacccuuaggguuaguggaucuuuuugucuucagcaccagcuuuuaucucauuagcaucuuccuccaccugguuaaaaucccaacccacagacaugucauaggaaaacccugccccaaaccacacagacucaaccacaugggcauaugcucaugugguuuauacaaacauccugguguaccaguuaaguggaaaagauaa

SEQ ID NO: 477 - RNA, 1473 nt, Artificial Sequence
  derived and/or modified CDS sequence (wt) from Lassa virus__AIT17482__GPC
augggacaaaucauaacauuuuuccaggaaguaccucaugucauagaggaagugaugaacauuguccugauugcucucagccuucuggcaauauugaaggggaucuacaauguugcuaccuguggccucuuuggauugguguccuuccuccucuuauguggaaggucauguucaacaacuuacaaggguguuuaugagcuacaaacucuggagcuagacauggcaagccuuaauaugacaaugcccuuaucuugcacgaagaacaacagccaccauuacaucauggucggaaaugaaacuggcuuggagcuaacuuuaacaaauacaaguaucaucaaccacaaauuuuguaaccucucugaugcacauaagaagaaucuuuaugaucaugcuuuaaugaguaucauuucaaccuuccacuuauccauuccuaacuuuaaucaguaugaagcaaugagcugugacuucaaugggggaaagauaaguguucaguacaaccuuagccacgcuuaugcuguagaugcagccaaccacugugggaccaucgccaauggcguucuucagacuuuuaugaggauggcuugggguggcagcuauauagcacuugauuccggaaaggggaguugggauuguauaaugacuuccuaccaauauuugauaauccaaaacaucacuugggaagaucacugccaguuuucucgcccauccccuaucgguuaccuagggcuacugucacaaaggaccagggacauuuacaucagucgaagacuucuugggacuuuuacuuggacucucucugauucugaagguaaugaaacaccggguggguauugccuaacaagauggaugcugauugaagccgaguugaaaugcuuugggaacacagcaguugcgaaaugcaaugagaaacaugaugaagaguuuugugacauguuaagauuguuugacuuuaacaaacaggcuauaaggaggcuaaagacagaagcacagaugaguauccaacugauaaacaaagcagugaacgcacugaucaaugaccagcugauuaugaagaaucauuugagagauaucauggggauuccuuacugcaauuacagcaaguacugguaucuaaaucauacuguaacagggaagacaucguugccaaggugcuggcuugugucaaaugguuccuaccugaaugagacacauuuuucugaugacauugaacaacaggcagacaacaugauaacagaacugcugcaaaaggaguacauagacaggcaagggaaaacaccuuuaggguuaguagaucuuuuugucuucagcaccagcuuuuaucucauuagcaucuuccuccaccugguuaaaaucccaacccacagacaugucguaggaaaacccugcccuaaaccacacagacucaaccacaugggcauauguucauguggucuauacaaacauccuggugugccagucaaguggaaaagauag

SEQ ID NO: 478 - RNA, 1473 nt, Artificial Sequence
  derived and/or modified CDS sequence (wt) from Lassa virus__AIT17486__GPC
augggacaaaucauaacauuuuuccaggaaguaccucaugucauagaggaagugaugaacauuguccugauugcccucagccuucuggcaauacugaaggggaucuacaauguugcuaccuguggccucuuuggauugguguccuuccuccucuuauguggaagaucauguucaacaacuuacaaggguguuuaugagcuacaaacucuggagcuagacauggcaagccuuaauaugacaaugcccuuaucuugcacgaagaacaacagccaccauuacaucauggucggaaaugagacuggcuuggagcugacuuuaacaaauacaaguaucaucaaccacaaauuuuguaaccucucugaugcacauaaaaagaaucuuuaugaucaugcuuuaaugaguaucauuucaaccuuccacuuauccauuccuaacuuuaaucaguaugaagcaaugaguugugacuucaauggggggaagauaaguguucaguacaaccuuagccacacuuaugcuguagaugcagccaaccacugugggacuaucgccaauggcguucuucagacuuuuaugaggauggcuugggguggcaguuauauagcacuugauuccggaaaggggaguugggacuguauaaugacuuccuaccaauauuugauaauccaaaacaccacuugggaagaucacugccaguuuucucgcccauccccugucgguuaccuggggcuacugucacaaaggaccagggacauuuacaucagucgaagacuucuugggacuuuuacuuggacucucucugauucugaagguaaugaaacaccggguggguauugucuaacaagauggaugcugauugaggccgaguugaaaugcuuugggaacacagcaguugcgaaaugcaaugagaaacaugaugaagaguuuugugacauguuaagauuguuugacuuuaacaaacaagcuauaaggaggcuaaagacagaagcacagaugaguauccagcugauaaacaaagcagugaacgcacugaucaaugaccagcugaucaugaagaaucauuugagagacaucauggggauuccuuacugcaauuacagcaaguacugguaucuaaaucauacuguaacagggaagacaucguugccaaggugcuggcuugugucaaauggcuccuaccugaaugagacacauuuuucugaugacauugaacaacaagcagacaacaugauaacagaacugcugcaaaaggaguacauagacaggcaagggaaaacaccuuuaggguuaguagaucuuuuugucuucagcaccagcuuuuaucucauuagcaucuuccuccaccugguuaaaaucccaacccacagacaugucauaggaaaacccugcccuaaaccacacagacucaaccacaugggcauauguucauguggucuauacaaacauccuggugugccagucaaguggaaaagauag

SEQ ID NO: 479 - RNA, 1473 nt, Artificial Sequence
  derived and/or modified CDS sequence (wt) from Lassa virus__AIT17490__GPC
augggacaaaucauaacauuuuuccaggaaguaccucaugucauagaagaagugaugaacauuguccugauuacccucagccuucuggcgauuuugaaagggaucuacaauguugccaccuguggccucuuuggauugguauccuuucuucucuuauguggaagaucaugcucaacaacuuacaaggguguuuaugagcuacaaacucuggagcuagacauggcaaaccuuaauaugacaaugcccuuaucuugcacaaagaauaacagccaccauuacaucauggucggaaaugagacugguuuagagcugacuuuaacaaauacaaguaucaucaaccauaaguucuguaaucuuucugaugcacauaaaaagaaucuuuaugaccaugcuuuaaugaguaucaucucaaccuuccacuuauccauucccaacuuuaaucaguaugaggcaaugagcugugacuucaauggggggaagauaaguguucaguacaaccuuagccacacuuuugcuguagaugcagcuaaccacugugggacuauugccaauggcguucuccagacuuucaugaggauggcuugggguggcaguuacauagcacuugauuccggaaaagggagcugggauugcauaaugacuuccuaccaauauuugauaauucagaacaccacuugggaagaucacugccaguuuucucgcccaucccccaucgguuaucuggggcugcugucacaaaggaccagggacauuuacaucagucgaagacuccuugggacuuuuacuuggacccucucugauucugaaggcaaugagacaccggguggguauugucuaacaagauggaugcugauugaagccgaauugaagugcuuugggaacacagcaguugcgaaaugcaaugagaaacaugaugaggaguuuugugacauguuaagauuguuugacuuuaacaaacaagcuauaaggaggcugaagacugaagcacagaugaguauccaacugauaaacaaagcagugaacgcauugaucaaugaccagcugauuaugaagaaucauuuaagggauaucaugggaauuccuuacugcaauuacagcaaguauugguauuuaaaucacacuguaacagggaagacaucguugccaagaugcuggcuugugucaaaugguuccuaccugaaugagacacauuuuucugaugacauugaacaacaagcagacaacaugauaacagaacuguugcagaaggaguacauggacaggcaagggaaaacacccuuaggguuaguagaucuuuuugucuucagcaccaguuuuuaucucauuagcaucuuucuccaccuaguuaaaaucccaacucacagacacaucauuggaaaacccuguccuaaaccacacagacucaaccacaugggcauaugcucauguggucuguacaaacauccugguguaccagucaaauggaaaagauag

SEQ ID NO: 480 - RNA, 1473 nt, Artificial Sequence
  derived and/or modified CDS sequence (wt) from Lassa virus__AIT17494__GPC
auggggcaaaucauaacauuuuuccaggaagugccucaugucauugaggaggugaugaacauugucuuaauugcucucagccuucuagcaauacuaaaaggggucuacaauguugccaccuguggccucuuuggguugguaucuuuucuucucuuauguggaaggucaugcucaacaauuuacaaggguguuuaugagcuucaaacucuggagcuggauauggcaagccuuaauaugacaaugcccuuauccugcacgaagaacaacagccaccacuacaucaugguuggaaaugagacugguuuggagcugacuuuaacaaacacaaguaucaucaaccacaaguuuuguaaccuuucugaugcacauaaaaagaaucucuaugaccaugcuuuaaugagcaucaucucaaccuuccaccuauccaucccuaacuuuaaucaguaugaagcaaugaguugugacuucaaugggggaaagauaaguguucaguacaaccucagccauacuuaugcuguggaugcagccaaccauugugggaccauugccaauggaguccuucaaacuuuuaugaggauggcuugggguggcaguuacauagcacuugauucuggaaaggggaguugggauuguauaaugacguccuaccaauauuugauaauccaaaacaccaguugggaagaccacugccaguuuucucgcccguccccuaucgguuaucuggggcuacuuucacaaagaaccagggacauuuacaucagccgaagacuccuaggaacuuuuacuuggacucucucugauucugagggcaaugaaacaccggguggguauuguuugacaagauggaugcugauugaagccgaauuaaagugcuuugggaacacagcaguugcgaaaugcaaugagaaacaugaugaagaguuuugugacauguuaagguuguuugacuuuaauaaacaggcuauaaggaggcuaaagacagaagcacagaugaguauccaacuaauaaacaaagcagugaacgcacugaucaaugaccagcucauuaugaagaaucauuuaagagauaucaugggaauuccuuacugcaauuacagcaaguauugguacuuaaaccacacuguaacagggaagacaucguugccaagaugcuggcuuguaucaaaugguucuuaccugaaugaaacacauuuuucugaugacauugagcagcaagcagacaacaugauaacagaauuguuacagaaagaguacauugauaggcaagggaaaacacccuuaggguugguggaucuuuuugucuucagcacuagcuucuaccuuauuagcaucuuccuccaccuggucaaaaucccaacccacagacacgucauagggaaacccugccccaagccacacagacucaaccacaugggcauaugcucauguggucuguacaaacauccugguguaccagucaaguggaaaagauag

SEQ ID NO: 481 - RNA, 1473 nt, Artificial Sequence
  derived and/or modified CDS sequence (wt) from Lassa virus__AIT17498__GPC
auggggcaaauuauaacauuuuuccaggaagugccucaugucauagaggaagugaugaacauuguccugauugcucucagccuucuggcaauucugaaagggaucuacaauguugcuacauguggccuuuuuggacugguguccuuucuccucuuauguggaagaucaugcucaacaacuuacaaggguguuuaugagcugcagacucuagagcuagacauggcaagccuuaacaugacaaugcccuuaucuugcacgaagaauaacucccaccauuacaucauggucggaaaugagacuggcuuagaacugacuuuaacaaauacaaguauuaucaaccacaaguuuugcaaccucucugaugcacauaagaagaaucuuuaugaccaugcuuuaaugagcaucaucucaaccuuccacuuauccauuccuaacuuuaaucaguaugaagcgaugagcugugacuucaauggggggaagauaaguguacaguacaaccucagccacacuuacgcuguggaugcggcuaaccacugugggaccauugccaauggcguucuucagacuuuuaugaggauggcuugggguggcaguuacauagcacuugauuccggaaaggggaauugggauugcauaaugacuuccuaccaauauuugauaauccaaaacaccacuugggaagaucacugccaguuuucucguccaucccccaucgguuaucuggggcuacugucacaaaggaccagggacauuuacaucagucgaagacuucuugggacuuuuacuuggacucucucugauucugaagguaaugaaacaccggguggguauugucuaacaagauggaugcugauugagaccgaguugaagugcuuugggaacacagcaguugcaaaauguaaugagaaacaugaugaagaguuuugugacauguuaagauuguuugacuuuaacaaacaagcuauaaguaggcugaggucagaagcacagaugaguauccaacuaauaaacaaagcagugaaugcacugaucaaugaccagcugauuaugaagaaucauuuaagagauaucaugggaauuccuuauugcaauuacagcaaauauugguaucuaaaucacacugugacagggaagacaucguugccaaaaugcuggcuugugucaaaugguucuuaccugaaugaaacacauuuuucugaugacauugaacaacaagcagacaacaugauaacagaaauguugcaaaaggaguacauagauaggcaagggaaaacaccuuuaggguuaguagaucuuuuugucuucagcaccaguuuuuaccuuauuagcaucuuccuccaccugguuaaaaucccaacccacagacauaucacagggaaacccugccccaaaccacacagacucaaccacaugggcauaugcucauguggucuauacaaacauccuggugugccagucaaguggaaaagauaa

SEQ ID NO: 482 - RNA, 1473 nt, Artificial Sequence
  derived and/or modified CDS sequence (wt) from Lassa virus__AIT17502__GPC
augggacaaauuauaacauuuuuccaggaaauaccucaugucauagaggaagugaugaacauuguccuaaucacccuuagccuucuggcaauacugaaagggaucuacaauguugcuaccuguggccuuuuuggacugguauccuuucuccucuuguguggaaaaucaugcucaacaaccuacaaaggugucuaugagcuacagacucuagaguuagacauggcaagccuuaauaugacaaugcccuugucuugcacgaagaacaacagccaucauuacaucauggucggaaaugagacugguuuggagcugacccugacaaauacaaguauuaucaaccacaaguuuuguaaccuuucugaugcacacaggaagaaccuuuacgaccauacuuuaaugaguaucaucucaaccuuccaccuguccauuccuaacuuuaaucaguaugaagcaaugagcugugauuucaauggggggaagauaaguguucaguacaaccuuagccacgcuuaugcuauagaugcagcuacccacugugggaccauugccaauggcguucuucagaccuucaugaggauggcuugggguggcaguuacauagcacuugauucaggaaagggggguugggauuguauaaugacuuccuaccaauauuugauaauccaaaacaccacuugggaagaucacugccaguuuucucgcccaucccccaucgguuaucuggggcuacugucacaaaggaccagggacauuuacaucagucgaaggcuucuugggacuuuuacuuggacccucucugauucugaagguaaugaaacaccggguggguauugucuaacaagauggaugcugauugaggccgaguugaaaugcuucgggaacacagcaguugcgaaaugcaaugagaaacaugaugaagaguuuugugacauguuaagguuguuugacuuuaacaagcaagcuauaaggagacugaaaacagaggcacagaugaguauacaacugauaaacaaagcagugaacgcacugauuaaugaccaacugaucaugaggaaucauuugagagauaucaugggaauuccuuacugcaauuacagcaaguauugguauuuaaaucacacuguaacagggaagacaucguugccaaaaugcuggcuugugucaaaugguuccuaccugaaugagacacauuuuucugaugacauugaacaacaagcagacaacaugauaacagaacuguugcaaaaggaguacauggacagacaagggaaaacacccuuaggguuaguagaucuuuuugucuucagcaccagcuuuuaucucauuagcaucuuccuccaucugguuaaaaucccaacucacagacaugucauagggaaacccugcccuaaaccacacagacucaaccacaugggcgugugcucauguggucuguacaaacauccugguguuccagucaaguggaaaagauaa

SEQ ID NO: 483 - RNA, 1473 nt, Artificial Sequence
  derived and/or modified CDS sequence (wt) from Lassa virus__AIT17506__GPC
augggacaaaucauaacauuuuuccaggaaguaccucaugucauagaggaagugaugaacauuguccugauugcucucagccuucuggcaauacugaaggggaucuacaauguugcuaccuguggccucuuuggauugguguccuuccuccucuuauguggaagaucauguucaacaacuuacaaggguguuuaugaacuacaaacucuggagcuagacauggcaagccuuaauaugacaaugcccuuaucuugcacaaagaacaacagccaccauuacaucauggucggaaaugagacuggcuuggagcugacuuuaacuaauacaaguaucaucaaccacaaauuuuguaaccucucugaugcacauaaaaagaaucuuuaugaucaugcuuuaaugaguaucauuucaaccuuccacuuauccauuccuaacuuuaaucaguaugaagcaaugagcugugacuucaauggggggaagauaaguguucaguacaaccuuagccacgcuuaugcuguagaugcagccgaacacugugggacuaucgccaaugguguucuucagacuuuuaugaggauggcuugggguggcaguuauauagcacuugauuccggaaaggggaguugggacuguguaaugacuuccuaccaauauuugauaauccaaaacaccacuugggaagaucacugccaguuuucucgcccauccccuaucgguuaccuagggcuacugucacaaaggaccagggacauuuacaucagucgaagacuucuugggacuuucacuuggacucucucugauucugaagguaaugaaacaccggguggguauugucuaacaagauggaugcuaauugaggccgaguugaaaugcuuugggaacacagcaguugcgaaaugcaaugagaaacaugaugaagaguuuugugacauguuaagauuguuugacuuuaacaaacaagcuauagagaggcuaaagacagaagcacagaugaguauccagcugauaaauaaagcagugaacgcacuaaucaaugaccagcugauuaugaagaaucauuugagagauaucauggggauuccuuacugcaauuacagcaaguacugguaucuaaaucauacuguaacagggaagacaucguugccaaggugcuggcuugugucaaaugguuccuaccugaaugagacacauuuuucugaugacauugaacaacaagcagacaauaugauaacagaaaugcugcaaaaggaguacauagacaggcaggggaaaacaccuuuaggguuaguagaucuuuuugucuucagcaccagcuuuuaucucauuagcaucuuccuccaccugguuaaaaucccaacccacagacaugucauaggaaaacccugcccuaaaccacacagacuuaaccacaugggcauauguucauguggucuauacaaacauccuggugugccagucaaguggaaaagauag

SEQ ID NO: 484 - RNA, 1473 nt, Artificial Sequence
  derived and/or modified CDS sequence (wt) from Lassa virus__AIT17510__GPC
augggacaaaucauaacauucuuccaggaaguaccccaugucauagaagaagugaugaacauuguccugauugcccucagccuucuggcaauauugaaagggaucuacaaugucgcuaccuguggccucuuuggauugguguccuuccuucucuuauguggaagaucaugcucaacaacuuacaaagguguuuaugagcuacaaacucuagagcuagacauggcaagccuuaacaugacaaugcccuuauccugcacaaagaacaacagccaccauuacaucauggucggaaaugagacuggcuuagagcugacuuuaacaaauacaaguaucaucaaccacaaguucuguaaccuuucugaugcacauaaaaagaaucuuuaugaccaugcuuuaaugaguauuaucucaaccuuccacuuauccauuccuaacuuuaaucaguaugaagcaaugaguugugacuucaauggggggaaaauaaguguucaguacaaccuuagccacacuuaugcuguagaugcagcuaaccacugugggacuauugccaauggcguucuccagacuuucaugaggauggcuugggguggcaguuacauagcacuugauuccggaaaagggagcugggauugcauaaugacuuccuaccaauauuugauaauccagaacaccaccugggaagaucacugccaguuuucucgcccaucccccaucgguuaucuggggcugcugucacaaaggaccaaggacauuuacaucagucgaagacuccuugggacuuuuacuuggacccucucugauucugaaggcaaugaaacaccggguggguauugucuaacaagauggaugcugauugaggccgaauugaagugcuuugggaacacagcaguugcgaaaugcaaugagaaacaugaugaggaguuuugugacauguuaagauuguuugacuuuaacaaacaggcuauaaggaggcugaagacagaagcacagaugaguauccaacugauaaacaaagcagugaacgcacugaucaaugaccagcugauuaugaagaaucauuuaagagacaucaugggaauuccuuacugcaauuacagcaaguauugguauuuaaaucacacugugacagggaagacaucguugccaagaugcuggcuugugucaaaugguuccuaccugaaugagacacauuuuucugaugacauugaacaacaagcagacaacaugauaacagaacuguugcagaaggaguacauagacaggcaagggaaaacacccuuaggguuaguagaucuuuuugucuucagcaccaguuuuuaucuuauuagcauuuuccuccaccuaguuaaaaucccaacucacagacauguuauaggaaagcccugcccuaaaccacacagacucaaccacaugggcauaugcucuuguggucuguacaaacauccugguguaccagucaaauggaaaagauag

SEQ ID NO: 485 - RNA, 1473 nt, Artificial Sequence
  derived and/or modified CDS sequence (wt) from Lassa virus__AIT17514__GPC
augggacaaaucauaacauuuuuccaggaagugccucaugucauagaggaagugaugaacauugucuugauugcucucagccuucuggcaguucugaaaggaaucuacaauguugcuacauguggccuuuuuggacugguguccuuucuccucuuauguggaagaucauguucaacaacuuacaaggguguuuaugagcuacaaacucuagagcuagauauggcaagccuuaacaugacaaugcccuuaucuugcaccaagaacaacucucaccauuacaucauggucggaaaugagacuggcuuggagcugacuuuaacaaauacaaguauuaucaaccacaaguuuuguaaccucucugacgcacauaaaaagaaucuuuaugaccaugcuuuaaugaguaucaucucaaccuuccacuuauccauuccuaacuuuaaucaguaugaagcaaugagcugugacuucaauggggggaagauaagugugcaguacaaccucagccacaccuaugcuguggaugcagcuaaccacugugggaccauugccaauggcguucuucagacuuuuaugaggauggcuuggggcggcaguuacauagcacuugauuccggaaaggggaguugggauugcauaaugacuuccuaccaauauuugauaauccagaacaccacuugggaagaucacugccaguuuucucgcccaucccccaucgguuauuugggacuacugucacaaaggaccagggacauuuacaucagucgaagacuucuugggacuuuuacuuggacucucucugauucugaagguaaugaaacaccagguggguauuguuuaacaagauggaugcugauugaggccgaguugaagugcuucgggaacacagcaguugcaaagugcaaugaaaaacaugaugaagaguuuugugacauguuaagauuguuugacuuuaacaaacaagccauaagaagguugaagacagaagcacagaugaguauccaacugauaaacaaagcagugaaugcacugaucaaugaccagcugauuaugaagaaucauuugagagauaucaugggaauuccuuacugcaauuacaguaaguauugguaucuaaaucacacuguaacagggaagacaucguugccaagaugcuggcuugugucaaauggcucuuaccugaaugaaacacauuuuucugaugacauugaacaacaggcagacaauaugauaacagaacuguugcaaaaggaguacauagacaggcaagggaaaacacccuuaggguuaguagaucuuuuugucuucagcaccaguuuuuaucuuauuagcaucuuccuccaccuaguuaaaaucccaacccacagacauguuauagggaaacccugccccaaaccacacagacucaaccacaugggcauaugcucauguggucuguacaggcauccuggugugccaguuaaguggaaaagauag

SEQ ID NO: 486 - RNA, 1473 nt, Artificial Sequence
  derived and/or modified CDS sequence (wt) from Lassa virus__AIT17518__GPC
auggggcaaaucauaacauuuuuccaggaaguaccucaugucauagaggaagugaugaacauuguccugauugcucucagucuucuggcaauacuaaaggggaucuacaauguugcuacuuguggccucuuuggauugguguccuuucuccucuuaugugggagaucaugcucaacaacuuacaaggguguuuaugagcuacaaacucuagagcuagacauggcaagccuuaacaugacaaugcccuugucuugcacaaagaacaacucccaccauuacaucaugguuggaaaugagacuggcuuggagcugaccuuaacaaauacaagcaucaucaaccacaaguuuuguaaccuuucugaugcacauaaaaagaaucuuuaugaccaugccuugaugaguaucaucucaaccuuccacuuauccauuccuaacuuuaaucaguaugaagcaaugaguugugacuucaaugggggaaagauaaguguucaguacaaccuuagccacgccuaugcuguagaugcagccaaccacuguggaaccauugccaauggcguccuucagacuuuuaugaggauggcuugggguggcaguuacauagcacuugauuccggaaaggggagcugggauugcauaaugacuuccuaccaauauuugauaauccaaaacaccacuugggaagaucacugccaauuuucccgcccaucccccaucgguuaucugggguugcugucacaaaggaccagggacauuuacaucaguagaagacuucuugggacuuuuacuuggacucucuccgacucugaagguaaugaaacaccggguggguauugucuaacaagauggaugcuaauugaagccgaguugaagugcuuugggaacacggcaguugcaaaaugcaaugagaaacaugaugaagaguuuugugacauguuaagauuguuugacuucaacaaacaagcuauaaggagacugaaaacagaagcacagaugaguauccaacugauaaacaaagcagugaacgcacugaucaaugaccagcugauuaugaagaaucacuugagggauaucaugggaaucccuuacugcaauuacaguaaauauugguaucuaaaucacacugugacagggaagacaucguugccaagaugcuggcuugugucaaaugguuccuaccugaaugagacacauuuuucugaugacauugaacaacaagcagacaacaugauaacagaacuguugcaaaaggaguacauggacaggcaaggaaaaacacccuuaggguuaguagaucuuuuugucuucaguaccagcuucuaucucauuagcaucuuccuccacuugguuaaaaucccaacccacagacaugucauaggaaaacccugcccuaaaccacacagacucaaccacaugggcauaugcucauguggucuguacaaacauccuggugugccagucaaauggaaaagauag

SEQ ID NO: 487 - RNA, 1473 nt, Artificial Sequence
  derived and/or modified CDS sequence (wt) from Lassa virus__AIT17524__GPC
augggacaaaucauaacauuuuuccaggaaguaccucaugucauagaggaagugaugaacauuguccugauugcucucagccuucuggcaauacugaaagggaucuacaauguugcuaccuguggccucuucggauugguguccuuccuccucuuauguggaagaucaugcucaacaacuuacaaggguguuuaugagcuacaaacucuggagcuagacauggcaagccuuaauaugacaaugcccuuaucuugcacgaagaauaacucccaccauuacaucauggucggaaaugagacuggcuuggagcugaccuugacaaauacaagcauuaucaaccacaaguuuuguaaccuuucugaugcccauaaaaagaaucuuuaugaccaugcuuuaaugaguaucaucucaaccuuccacuuguccauuccuaacuuuaaucaguaugaagcaaugaguugugauuucaaugggggaaagauaaguguucaguacaaccuuagccacacuuaugcuauagaugcagccaaccacugugggaccauugccaauggcguucuucagacuuucaugagaauggcuugggguggcaguuacauagcacuugauuccggaaaggggagcugggauugcauaaugacuuccuaccaauauuugauaauccaaaauaccacaugggaagaucacugccaguuuucucgcccaucccccaucgguuaucuggggcuacuaucacaaagaaccagagacauuuacauuagucgaagacuucuugggacuuucacuuggacucucucugacucugaagguaaugaaacaccggguggguauugucuaacaagauggaugcugauugaggccgaguugaagugcuuuggaaacacagcaguugcaaaaugcaaugaaaaacaugaugaagaguuuugugauauguugagauuguuugauuucaacaagcaagcuauaaggaggcuaaagacagaagcacagaugaguauccaacugauaaacaaagcggugaacgcacugaucaaugaccagcuaaucaugaagaaucauuugagagauaucaugggaauuccuuacugcaauuacagcaaguauugguaucuaaaucacacuguaacagggaagacaucguugccaagaugcuggcuugugucgaaugguucuuaccugaaugagacacauuuuucugaugacauugagcaacaagcagacaacaugauaacagaaauguugcaaaaggaguacauggacaggcaagggaaaacacccuuaggguuaguagaucuuuuugucuucagcaccagcuuuuaucucauuagcaucuuccuccaccuaguuaaaauuccaacccacagacaugucauagggaaacccugcccuaaaccacacagacucaaccacaugggcauauguucauguggucuguacaagcauccuggcgugccagucaaguggaaaagauag

SEQ ID NO: 488 - RNA, 1473 nt, Artificial Sequence
  derived and/or modified CDS sequence (wt) from Lassa virus__AIT17528__GPC
auggggcaaaucauaacauucuuccaagaggugccucaugucauagaggaggucaugaacaucguccuaaucgcccucagucuccuggcgaugcugaaagggauuuacaauauugcuaccuguggucucuuuggguugaucuccuuucuucucuuauguggcagaucauguucaacaaccuauaaaggugucuaugaguuacaagcucuagagcuggacauggcaaaccucaacaugacaaugcccuuguccugcacgaagaacaauagccaccauuauaucaugguuggaaaugaaacaggcuuggagcugaccuuaacaaauacaagcaucauaaaccacaaguuuugcaaucucucugaugcacauaaaaagaaucucuaugaccaugccuugaugagcaucaucucaaccuuccacuuauccauuccaaacuucaaucaguaugaagcaaugagcugugacuuuaauggagggaaaauaaguguucaguacaaccucagucacacuuaugcuggggaugcagccaagcauugcgggaccauugccaaugguguacugcagacuuucaugaggauggcuugggguggcaguuacauagcacuugauuccggaaagggaaacugggauuguauaaugacuuccuaucaauacuugauaauucaaaacaccacuugggaggaucacugccaguuuucccgcccaucuccaauugguuaccugggacuauugucacagagaacuagagauaucuacauuagucgaagacuucucggaaccuucaccuggacccuuucugauuccgaaggcaacgaaacaccugguggguacugucuaacuagauggauguuaauugaagcagaacugaagugcuuugggaacacagcagucgcaaagugcaacgagaaacaugaugaagaauuuugugacauguugagguuguuugauuucaacaaacaagcuauaaggaggcuaaaaacagaggcacagaugaguauucagcugauaaacaaggcagugaaugcauuaaucaaugaccaauuaaucaugaaaaaccacuuaagggacaucaugggaauuccuuauugcaauuacaguaaauauugguaucuaaaucacucugugacagggagaacaucacugccaagauguuggcuuguaucaaaugguuccuaccuaaaugaaacacaauuuucugaugacauugaacaacaggcagacaacaugauaacagaaauguugcagaaagaguauauagacaggcagggaaaaacacccuuaggguugguugaccuuuuugucuucagcacuagcuuuuaucucauaagcaucuuucuccaccugaucaagaucccaacucacagacacaucguagggaaacccuguccuaagccgcacaggcuuaaccauaugggcauuugcucauguggucuauacaaacauccugguaucccagucaaauggaagagauag

SEQ ID NO: 489 - RNA, 1473 nt, Artificial Sequence
  derived and/or modified CDS sequence (wt) from Lassa virus__AIT17538__GPC
augggacaaauaauaacauucuuucaggagguuccucauguuauagaagaggugaugaauauuguccugauugcucucagccuccuggcaauacugaaggggauuuacaauauugccacuuguggccucuuugggcugaucuccuuucuucuucuguguggaagaucaugcucaacaaccuacaaaggugucuaugagcuacaaacccuggagcuggauauggcaaaccucaacaugaccaugccucuaucuugcacaaaaaacaacagccaucacuauaucaugguugggaaugagacaggccuagaacugaccuuaacaaacacaaguauaaucaaucauaaguucugcaaccuuucugaugcacacaaaaagaaucuuuaugaucaugccuugaugagcaucauuucaacuuuccacuuauccauuccgaacuucaaucaguaugaagcaaugaguugugacuuuaaugaagggaaaauaagugugcaauacaaucucagucauaguuaugcuauagaugcagccggccacugugggaccauugccaacgguguccuacagacuuucaugagaauggcuuggggcggcaguuacauagcacuugauucuggaaaagggaacugggauugcauaaugacuuccuaucaguacuugauuauccagaacaccaccugggaagaucacugucaauuuucccgcccauccccuauuggguaccuaggacugcugucacagagaacuagagauauuuauauuagucggagacuucuuggaacuuucaccuggacucucucugacucugagggcaaugaagcacccgguggauacugccuuacuagauggaugcuaauugaagcugaacugaagugcuuugggaacacagccauugcaaaguguaaugagaagcacgaugaggaauucugugauauguugagacuuuuugacuucaacaaacaagccauaaaaaggcuaaaagcagaagcacagaugagcauccauuugauaaauaaagcaguaaaugcacuaaucaaugaccaguugaucaugaagaaccacuugagggauaucaugggaauuccuuauugcaauuacagcaaguacugguaucuaaaccacacugugacagggaagacaucauugccgaaguguuggcuuguuucaaaugguucuuaccugaaugagacacauuucuccgaugauauugaacagcaagcagauaacaugauaacagaacuguugcaaaaggaguauauggacaggcaggggaaaacaccauuaggguuaguggaucuuuuugucuucagcaccagcuuuuaucucauaaguauuuuccuccacuuggucaaaauucccacccauagacacauuguggggagacccugccccaaaccacacaggcucaaccacaugggcauaugcucaugugguuuguacaaacauccugguguaccagucaaguggaagagauag

SEQ ID NO: 490 - RNA, 1473 nt, Artificial Sequence
  derived and/or modified CDS sequence (wt) from Lassa virus__AIT17540__GPC
augggacaaauagugacauucuuucaagaaguuccucaugucauugaggaaauuaugaacauuguccucaucacuuugucucuacuugcaauucuuaaggggauauacaacuuugccacauguggucuuauuggucugaucacauuccucuuucuuuguggaaggucauguucaacaaucuacaaaggaagcuaucaacuccagacacuugagcuaaacauggaaacacucaauaugaccaugccuuuauccuguacaaaaaacaacagucaccacuauauaagagugggcaaugagacaggacuggaauuaaccuuaacuaacacaagcaucauaaaccauaaguucugcaaucuuucugaagcacacaaaaagaaucucuaugaccaugcccucaugagcaucaucuccaccuuccauuugucuauucccaauuucaaucaguaugaagcaaugaguugugacuucaauggaggcaagaucagcguucaguacaaucuaagucauaguuaugcaguggaugcagccaaucauugcggcacuguagcaaauggugugcugcagacuuuuaugaggauggccugggguggaagcuacaucgcacuugauucaggccgaggaaauugggacugcauaaugacaagcuaccaauacuuaaucauucagaauacgacaugggaagaccacugucaguucucaagaccaucucccauugguuaucuuggacuucuaucacaaagaaccagagauauuuacaucagcagaagacuguugggaacguuuacauggacacuaucagauucugaagguaaagaaaccccaggaggcuacugcuuaacuagauggauguuaauugaagcugaguuaaaguguuucgggaacacugcgguggcuaaaugcaaugagaaacaugaugaggaauuuugugauaugcugaggcuuuuugacuucaacaagcaagccauucagagguugaagacugaggcacagaugagcauucagcuuaucaacaaagcagucaacgcucuuauuaaugaccagcuuauaaugaaaaaccaccucagagacaucauggguauaccauauuguaauuacaguaaauacugguaucuuaaucauacauccacaggcaggaccucacuaccaaaauguuggcuugugucaaauggauccuaccucaaugagacucauuuuucagaugauauagaacaacaagccgacaauaugauaacggagauguuacagaaggaguacauagauaggcaagggaagaccccacuuggauugguugacuuauuuguauucagcacuaguuucuaccucaucaguauuuuccuucauuugguuaagaucccaacucauaggcacauugugggcaaaucaugucccaaaccucacaggcuaaaccauaugggcaucuguuccuguggacuguacaaacagccagggguaccugugaaguggaagagauaa

SEQ ID NO: 491 - RNA, 1473 nt, Artificial Sequence
  derived and/or modified CDS sequence (wt) from Lassa virus__AIT17544__GPC
augggacaaaucauaacauuuuuccaggaaguaccucaugucauagaggaggugaugaacauuguccugauugcucucagccuucuggcaauacugaaaggaaucuacaauguugcuaccuguggccucuuuggacugguauccuuucuccucuuauguggaagaucgugcucaacaaccuauaaagguguuuaugagcuacaaacucuagagcuggacaugggaagccuuaauaugacaaugccccuaucuuguacgaagaacaacagccaucauuacaucauggucggaaaugagacuggcuuggagcugacuuuaacaaauacaaguauuaucaaccacaaguuuuguaaccuuucugaugcacauaagaagaaucuuuaugaccaugcgcuaaugaguaucaucucaaccuuccacuuauccauuccuaacuuuaaucaguaugaagcaaugaguugugacuucaauggggggaagauaaguguucaauacaaucuuagccacucuuaugcuguggaugcagccaaccacugugggaccauugccaauggcguucuucaaacuuuuaugaggauggcuugggguggcaguuacauagcacuugauuccggaaaggggaguugggauuguauaaugacuuccuaccaauauuuaauaauccaaaacaccacuugggaagaucacugccaguuuucucgcccauccccuaucgguuaucuggggcuacugucacaaaggaccagggacauuuacaucagucgaagacuacucgggacuuuuaccuggacccucucugauucugaagguaaugaaacaccggguggguauugucuaacaagauggaugcugauugaggccgaguugaagugcuuugggaacacagcaguugcgaagugcaaugaaaaacaugaugaagaguucugugacaugcuaagauuauuugacuuuaacaaacaagcuauaaggaggcugaaaacagaagcacagaugaguauccaacugauaaacaaagccguaaacgcacugaucaacgaccagcugauuaugaagaaucauuugagagacauuaugggaauuccuuacugcaauuacagcaaguauugguaucuaaaucacacuguaacagggaagacaucauugccaagaugcuggcuugugucaaaugguuccuaccuuaaugagacacacuuuucugaugacauugaacaacaagcagauaacaugauaacagaacuguugcaaaaggaguacauggacaggcaagggaaaacucccuuaggguuaguagaucuuuuugucuucagcaccagcuuuuaccucauuagcaucuuccuccaccuggucaaaaucccaacccacagacauaucauagggaaacccugcccuaaaccacacaggcucaaccacaugggcauaugcucauguggucuguacaagcauccugguguaccagucaaguggaaaagauag

SEQ ID NO: 492 - RNA, 1473 nt, Artificial Sequence
  derived and/or modified CDS sequence (wt) from Lassa virus__AIT17548__GPC
augggacaaaucauaacauuuuuccaggaaguaccucaugucauagaggaagugaugaacauuguccugauugcucucagccuucuggcgauacugaaagggaucuacaauguugcuaccuguggccucuuuggauugguguccuuucucuucuuauguggaagaucaugcucaacaacuuacaaggguguuuaugaacugcaaacucuagagcuagacauggcaagccucaauaugacaaugccccuaucuugcacaaagaacaacagccaccauuacaucauggucggaaaugagacuggcuuggagcugacuuuaacaaauacaaguauuaucaaccacaaguuuuguaaccuuucugaugcacauaaaaggaaucuuuaugaccaugcuuuaaugagcaucaucucaaccuuccacuuaucuauuccuaauuuuaaucaguaugaagcaaugaguugugacuucaauggggggaagauaaguguucaguacaaccuuagucacgcuuaugcuggagaugcagccaagcacugugggacuauugccaauggcguucuucagacuuuuaugaggauggccugggguggcaguuauauagcacuugauuccggaaaggggaguugggauuguauaaugaccuccuaccaauauuugauaauccaaaacaccacuugggaagaucacugccaguuuucucgcccguccccuaucgguuaucuggggcuacugucacaaaggaccagggacauuuacaucagucgaagacuucuugggacuuuuacuuggacucucucugauucugaagguaaugaaacgccggguggguauugucuaacaagauggaugcugauugaggccgaguugaagugcuuugggaacacagcaguugcgaaauguaaugagaaacaugaugaagaguuuugugacauguuaagacuguuugacuuuaacaaacaagcuaucaggaggcugaggacagaagcacagaugaguauccaacugauaaacaaagcagugaacgcacugaucaaugaccagcuuauuaugaagaaucacuugagagacauuaugggaauuccuuacugcaauuacagcaaguacugguaucuaaaucacaccguaacagggaagacaucguugccaaagugcuggcuugugucaaaugguuccuaccugaaugagacacauuuuucugaugacauugaacaacaagcagacaacaugauaacagaaauguugcaaaaggaguacauugacaggcaagggaaaacacccuuaggguuaguagaucuuuuugucuucagcacuaguuuuuaucucauuagcaucuuccuccaccuggucaaaaucccaacucacagacaugucauaggaaaacccugcccuaaaccacacagacucaaccacaugggcauaugcucauguggucuguacaaacauccugguguaccagucaaguggaaaagauaa

SEQ ID NO: 493 - RNA, 1473 nt, Artificial Sequence
  derived and/or modified CDS sequence (wt) from Lassa virus__AIT17552__GPC
auggggcaaaucauaacguuuuuccaggaagugccucaugucauagaggaggugaugaacauugucuugauugcucucagccuucuggcaauacugaaagggaucuacaaugucgccaccuguggccucuuuggguugguguccuuucuucuccuauguggaagaucaugcucaacaacuuacaaggguguuuaugagcuacaaacucuagaacuagacauggcaagccucaauaugacaaugcccuuauccugcacgaagaauaacagccaccauuacauuauggucggaaaugagacuggcuuggagcuaaccuuaacaaacacaagcauuaucaaucauaaguuuuguaaccuuucugaugcacauaaaaagaaccuuuaugaccaugcuuuaaugaguaucaucucaaccuuucauuuauccauucccaacuuuaaccaguaugaagcaaugaguugugacuucaaugggggaaagauaaguguucaguacaaccucagccaugcuuaugcugugaaugcagcuaaccacugugggaccauugccaaugguguucuacagacuuuuaugaggauggcuugggguggcagcuacauagcacuugauuccggaaagggaagcugggacuguauaaugacuuccuaccaguauuugauaauccaaaacaccacuugggaagaucacugccaguuuucucgcccguccccuaucgguuaucuggggcuacuaucacaaagaacuagagacaucuauauaagucgaagacuucuuggaacuuucacuuggacucuuucugauucugaagguaaugaaacaccagguggguauuguuuaacaagauggaugcugauugaggccgaguugaaaugcuuugggaacacagcaguugcaaaguguaaugagaaacaugaugaagaguuuugugacauguuaagauuguuugacuuuaacaaacaagcuauaaggagguugaagacagaagcacagaugagcauccaacugauaaacaaagcagugaacgcacuaauuaaugaccaguugaucaugaagaaccauuuaagggauauuaugggaauuccuuacuguaauuacagcaaguauugguauuugaaucacacuguaacagggaaaacaucgcugccaagaugcuggcuugugucaaaugguuccuaccuaaaugagacacacuuuucugaugacauugaacaacaagcagacaacaugauaacagaauuguuacagaaagaguacauggacagacaaggaaaaacaccuuugggguugguagaucuuuuugucuucagcaccagcuuuuaucucaucagcauuuuccuccaccugguuaaaaucccaacccacagacaugucauagggaaacccugcccuaaaccacacagacucaaccacaugggcauaugcucaugugguuuguauaaacaucccggugugccagucaaguggaagaaauag

SEQ ID NO: 494 - RNA, 1473 nt, Artificial Sequence
  derived and/or modified CDS sequence (wt) from Lassa virus__AIT17556__GPC
augggacaaaucauaacauuuuuccaggaaguaccucaugucauagaggaagugaugaacauuguccugauugcucucagccuucuggcaauauugaaagggaucuacaauguugcuaccuguggccucuuuggauugguguccuuucuccuccuauguggaaggucauguucaacaacuuacaaggguguuuaugagcugcaaacucuagagcuagacauggcaagccucaauaugacaaugcccuuaucuugcacgaagaacaacagccaucauuacaucauggucggaaaugaaacuggcuuagagcuaacuuuaacaaauacaagcaucaucaaccacaaguucugcaaccuuucugaugcacauaaaaagaaucucuaugaucaugcucuaaugaguaucaucucaaccuuccacuuguccauuccuaacuucaaucaguaugaggcaaugaguugugacuucaauggggggaagauaaguguucaguacaaccuuagccacacuuaugcuguagaugcagcuaaccacugugggaccauugccaauggcguucuucagacuuuuaugaggauggcuugggguggcagcuacauagcacuugauucuggaagggggaguugggauuguauaaugacuuccuaccaauauuugauaauccaaaacaccacuugggaagaucacugccaguuuucccguccguccccuauagguuaucuggggcuacuaucacaaaggaccagggacaucuacaucagucgaagacuucuugggacuuuuacuuggacucucucugauucugaagguaaugaaacaccggguggguauugucuaacaagauggaugcugauugaggccgagcugaagugcuuugggaacacagcaguugcgaaaugcaaugagaaacaugaugaagaguuuugugacauguugagguuguuugacuuuaacaaacaagcuauaagaaggcugaagacagaggcacaaaugaguauccaacugauaaacaaagcagugaacgcauugaucaaugaccagcuaaucaugaagaaucauuugagagauauuaugggaauuccuuacugcaauuacagcaaguacugguaucuaaaucacacuauaacagggaagacaucguugccaagaugcuggcuugugucaaaugguuccuaccugaaugaaacacauuuuucugaugacauugaacaacaagcagacaacaugauaacagaacuguugcagaaggaguacauagacaggcaagggaaaacacccuuaggguuaguagaucuuuuugucuucaguacuagcuuuuaucucauuagcaucuuccuccaccugguuaaaaucccaacccacaggcauaucacagggaaacccugccccaaaccacacagacucaaccacaugggcauaugcucaugugguuuguacaaacauccuggugugccaguuagauggaaaagauag

SEQ ID NO: 495 - RNA, 1473 nt, Artificial Sequence
  derived and/or modified CDS sequence (wt) from Lassa virus__AIT17560__GPC
augggacaaaucauaacauuuuuccaggagguaccucaugucauagaggaagugaugaacauuguucugauugcucucagccuucuggcaguacugaaagggauuuacaauguugcuaccuguggccucuuuggauugguguccuuucuccucuugugcggaagaucaugcucaacaacuuacaaggguguuuaugagcuacaaacccuagaguuggacauggcaagccuuaauaugacaaugcccuuaucuugcacgacgaacaacagccaccauuacaucauggucggaaaugagacagguuuggagcucacuuuaacaaauacaaguauuaucaaccauaaguuuuguaaccuuucugaugcacauaaaaagaaucuuuaugaccaugcucuaaugaguaucaucucaaccuuccauuuauccauuccuaacuuuaaucaguaugaagcaaugaguugugacuucaauggggggaagauaaguguucaguacaaccuuagucacgcuuaugcuggagaggcagccaaucacugugggaccaucgccaauggcguucuucagacuuuuaugaggauggcuugggguggcaguuacauagcacuugauuccggaaaggggaguugggauuguauaaugacuuccuacaaauauuugauaauccaaaacacuacuuggggagaucacugccaguuuucucgcccauccccuaucgguuaucuggggcuacugucacaaaggaccagggacauuuacaucagucgaagacuucuugggacuuuuaccuggacucuuucugauucugaggguaaugaaacaccggguggguauugucuaacaagauggaugcugauugaggccgaauugaagugcuuugggaauacagcaguugcgaaaugcaaugagaaacaugaugaagaguuuugugacauguuaagauuauuugacuucaacaaacaagcuauaaggaagcugaagacagaagcacagaugagcauccaacugauaaacaaagcagugaacgcauugaucaaugaccaacugaucaugaagaaucauuugagagauaucaugggaauuccuuacuguaauuacagcagguacugguaucuaaaucacacuguaacagggaggacgucauugccaaggugcuggcuuguaucaaaugguuccuaucugaacgagacacacuuuucugaugacauugaacaacaagcagacaacaugauuacagaacuguugcaaaaggaguacauagauaggcaggggaaaacacccuuaggguuaguggaucuuuuugucuucagcaccagcuuuuaucucauuagcaucuuccuccaccuggucaaaaucccaacccacagacauaucauagggaaaccuuguccuaaaccacacagacucaaccacaugggcauaugcucauguggucuauacaaacauccugguguaccagucaaguggaagagauag

SEQ ID NO: 496 - RNA, 1473 nt, Artificial Sequence
  derived and/or modified CDS sequence (wt) from Lassa virus__AIT17564__GPC
auggggcaaaucauaacauuuuuccaggaagugccucaugucaucgaggaagugaugaacauuguccuaauugcucucagccuucuagcaauacuaaaagggauuuacaauguugcuaccuguggccucuuuggguugcuguccuuccuucucuuauguggaaggucaugcucaacaacuuacaaggguguuuaugagcuucaaacucuggagcuggauauggcaagccucaauaugacaaugcccuuauccuguacgaagaacaacagccaccacuacaucaugguuggaaaugagacuggcuuggagcugacuuuaacaaacacgaguaucaucaaccacaaguucugcaaccuuucugaugcacauaaaaaggaucucuaugaccaugcuuuaaugagcaucaucucaaccuuccaccuauccaucccuaacuuuaaucaguaugaagcaaugaguugugacuucaaugggggaaagauaaguguucaguacaaccucagccaugcuuaugcuguggaugcagcuaagcauugugggaccauugccaauggaguccuucaaacuuuuaugaggauggcuugggguggcaguuacauagcacuugauucuggaaaggggaguugggauuguauaaugacguccuaccaauauuugauaauccaaaacaccaguugggaggaucacugccaguuuucucgcccguccccuaucgguuaucuggggcuacugucacaaagaaccagggacaucuacaucagccgaagacuccuuggaacuuuuacuuggacucucucugauucugagggcaaugaaacaccggguggguauuguuuaacaagauggaugcugauugaagccgaauuaaagugcuuugggaacacagcaguugcgaaaugcaaugagaagcaugaugaagaguuuugugacauguuaagguuauuugacuuuaacaagcaggcuauaaagagguuaaagacagaagcacagaugaguauccaacuaauaaacaaagcagugaacgcacugaucaaugaccagcucauuaugaagaaccauuugagagauaucaugggaauuccuuacugcaauuacagcaaguauugguauuuaaaccacacuguaacagggaagacaucguugccaagaugcuggcuuguaucaaaugguuccuaccugaaugaaacacauuuuucugaugacauugagcaacaagcagacaacaugauaacagaauuguuacagaaagaguacauugacaggcaagggaaaacacccuuaggguugguggaucuuuuugucuucagcacuagcuucuaccuuauuagcaucuuccuccaccugguuaaaaucccaacccacagacaugucauagggaaacccugccccaagccacacagacucaaccacaugggcauaugcucauguggucuauacaaacauccugguguaccagucaaguggaaaagauag

SEQ ID NO: 497 - RNA, 1473 nt, Artificial Sequence
  derived and/or modified CDS sequence (wt) from Lassa virus__AIT17572__GPC
augggacaaaucauaacauuuuuccaggaaguaccucaugucauagaggaaguuaugaacauuguccugauugcucucagccuucuggcaauacugaaagggaucuacaauguugcuaccuguggccucuuuggacugguguccuuucuucucuuauguggaagaucaugcucaacaacuuacaaggguguuuaugagcuacaaacucuagagcuagacauggcaaaccuuaauaugacaaugcccuuauccugcacgaaaaacaacagccaccauuacaucauggucggaaaugagacuggucuggagcugacuuuaacaaauacaaguaucaucaaccacaaguuuuguaaccuuucugaugcacauaaaaagaaucuuuaugaccaugcuuuaaugaguauuaucucaacuuuccacuuauccauuccuaacuuuaaucaguaugaagcaaugaguugugacuucaauggggggaagauaaguguccaguacaaccuuagccacaauuaugcuguagaugcagcuaaucacugugggacuauugccaauggcguacuucagacuuuuaugaggauggcuuggggugguaguuacauagcacuugauuccggaaaggggaauugggauugcauuaugacuuccuaccaauauuuaauaauccaaaauaccacuugggaagaucacugucaguuuucucgcccauccccuauugguuaucugggguuacugucacaaaggaccagggacauuuacauuagucgaagacuucuugggacuuucacuuggacucucucugauucugaagguaaugauaugccggguggguauugucuaacaagauggaugcugauugaggccgaguugaagugcuuugggaacacagcaguugcgaaaugcaaugagaaacaugaugaagaguuuugugacauguuaagauuguuugacuuuaacaaacaagccauaaggagguugaagacagaagcacagaugaauauccaacugauaaacaaagcagugaacgcacugaucaaugaccagcugaucaugaagaaucauuuaagagauaucaugggaauuccuuacugcaauuacagcaaguauugguacuugaaucacacuguaacagggaaaacaucguugccaagauguuggcuugugucaaaugguuccuacuugaaugagacacauuuuucugaugacauugaacaacaagcagacaauaugauaacagaacuguugcaaaaggaguacauggacaggcaagggaaaacacccuuaggguuaguagaucuuuuugucuucagcaccagcuuuuaucucauuaguaucuuccuucaccugguuaaaaucccaacccacagacauaucauagggaaacccugcccuaaaccacacagacucaaccacaugggcauaugcucauguggucuguacaaacauccugguguaccagucaaguggaaaagauag

SEQ ID NO: 498 - RNA, 1473 nt, Artificial Sequence
  derived and/or modified CDS sequence (wt) from Lassa virus__AIT17576__GPC
auggggcaaauuauaacauuuuuccaagaaguaccucaugucauagaggaagugaugaacauuguccugauugcucucagccuucuggcaauucugaaagggaucuacaauguugcuacauguggccuuuuuggacuggugucuuuucuccucuuauguggaagaucaugcucaacaacuuacaaggguguuuaugagcuacagacucuagagcuagacauggcuagccuuaacaugacaaugcccuuaucuugcacgaagaacaacucccaccauuacaucauggucggaaaugagacuggcuuggagcugacuuuaacaaauacaaguauuaucaaccacaaguuuugcaaccucucugaugcacauaagaagaaucuuuaugaccaugcuuuaaugaguaucaucucaaccuuccacuuauccauucccaacuuuaaucaauaugaagcgaugagcugugacuucaauggggggaagauaagugugcaguacaaccucagccacacuuacgcuguggaugcggcuaaccacugugggaccauugccaauggcguucuucagacuuuuaugaggauggcuugggguggcaguuacauagcacuugauuccggaaaggggaauugggauugcauaaugacuuccuaccaauauuugauaauccaaaacaccacuugggaagaucacugccaguuuucucguccaucccccaucgguuaucuggggcuacugucacaaaggaccagggacauuuauaucagucgaagacuucuugggacuuucacuuggacucucucugauuccgaagguaaugaaacaccggguggguauugucuaacaagauggaugcugauugaggccgaguugaagugcuuugggaacacagcaguugcaaaauguaaugagaaacaugaugaagaguuuugugacauguuaagauuguuugacuuuaacaaacaagcuauaaguaggcugaagacagaagcacagaugaguauccaacugauaaacaaagcaguaaaugcacugaucaaugaccagcugauuaugaagaaucauuugagagauaucaugggaauuccuuauugcaauuacagcaaauauugguaucuaaaucacacuguaacagggaagacaucguugccaagaugcuggcuugugucaaaugguuccuaccugaaugaaacacauuuuucugaugacauugaacaacaagcagacaacaugauaacagaaauguugcaaaaggaguacauagauaggcaagggaaaacacccuuaggguuaguagaucuuuuugucuucagcaccaguuuuuaccuuauuagcaucuuccuccaccugguuaaaaucccaacccacagacacaucacagggaaacccugccccaaaccacacagacucaaccacaugggcauaugcucauguggucuauacaaacauccuggugugccagucaaguggaaaagauag

SEQ ID NO: 499 - RNA, 1473 nt, Artificial Sequence
  derived and/or modified CDS sequence (wt) from Lassa virus__AIT17580__GPC
auggggcaaaucauaacauuuuuccaggaagugccucaugucauagaagaagugaugaacauuguccugauugcccucagccuuuuggcaauauugaaagggaucuacaauguugcuacuuguggccucuuuggacugguguccuuucuucucuuauguggaagaucaugcucaacaacuuacaaagguguuuaugagcuacaaacucuagagcuagacauggcaagccuuaauaugacaaugcccuuaucuugcacaaagaauaauagccaccauuacaucauggucggaaaugaaacuggcuuagagcugacuuuaacaaauacaaguaucaucaaccacaaguuuuguaaccuuucugaugcacauaaaaagaaucuuuaugaccaugcuuuaaugagcaucaucucaaccuuccacuuauccauuccuaacuuuaaucaauaugaagcaaugaguugugacuucaauggggggaagauaaguguucaguacaaccuuagccacacuuaugcuguagaugcagcuaaccacugugggacuauugccaauggcguucuucagacuuucaugaggauggcuugggguggcagcuacauagcacuugauuccggaaaagggaguugggauuguauaaugacuuccuaccaauaucugauaauccagaacaccacuugggaagaucauugccaguuuucucgcccaucccccaucgguuaucuggggcuacugucacaaaggaccagggacauuuacaucagucgaagacuccuugggacuuuuacuuggacccucucugauucugaaagcaaugaaacuccagguggguauugucuaacaagguggauguugauugaggccgagcugaagugcuuugggaacacagcaguugcgaaaugcaaugaaaaacaugaugaagaguuuugugacaugcuaagauuguuugacuuuaacaaacaagcuauaaggaggcugaaagcagaagcacagaugagcauccaacuaauaaacaaagcagugaaugcacugaucaaugaccagcugauaaugaagaaucauuuaagagauaucaugggaauuccuuacugcaauuacagcaaauauugguacuugaaucacacuguaacagggaggacaucguuaccaagaugcuggcuugugucaaaugguuccuaccugaaugagacacauuuuucugacgacauugaacaacaagcagacaauaugauaacagaacuguugcagaaggaguacauggacaggcaagggaaaacaccuuuaggguuaguagaucuuuuugucuucagcaccagcuuuuaucucaucagcaucuuccuccaccugguuaaaaucccaacccacagacaugucauagggaaacccugcccuaaaccacacagacucaaccacaugggcauaugcucauguggucuguacaaacauccuggugugccagucaaguggaaaagauag

SEQ ID NO: 500 - RNA, 1473 nt, Artificial Sequence
  derived and/or modified CDS sequence (wt) from Lassa virus__AIT17584__GPC
augggacaaaucauaacauuuuuccaggaaguaccucaagucauagaggaagugaugaacauuguccugauugcucucagccuucuggcaauacugaaagggaucuacaauguugcuaccuguggccucuuuggauugguguccuuucuccucuuguguggaagaucaugcucgacaaccuacaagggcguuuaugagcuacaaacccuagagcuagacauggcaagccuuaauaugacaaugcccuuaucuugcacgaagaacaacagccaucauuacaucauggucggaaaugagacuggcuuggagcugacuuuaacaaaccaaaguauuaucaaccacaaguuuuguaaccuuucugaugcacauaaaaagaaucuuuaugaccaugcuuuaaugaguaucaucucaaccuuccacuuauccauucccaacuuuaaucaauaugaagcaaugaguugugacuucaauggaggaaagauaaguguucaguacaaccuuagccacucuuuugcuguagaugcagcuaaccacuguggaaccauugccaaugguguucuucagacuuuuaugaggauggcuugggguggcaguuacauagcacuugauuccggaaaggggaguugggacugcauaaugacuuccuaccaauauuugauaauccaaaacaccacuugggaagaucacugucaauuuucucgcccauccccuaucgguuaucuggggcuacugucacaaaggaccagggauauuuacaucagccgaaggcuucuugggacuuucacuuggacucucucugauucugaagguaaugaaacaccggguggguauugucuaacaagauggaugcugauugaggccgagcugaagugcuuugggaacacagcaguugcgaagugcaaugagaaacacgaugaagaguuuugugacauguuaagguuguuugacuuuaacaaacaagcuauaaggaggcugaagacggaagcacagaugaguauccaauuaauaaacaaagcaguaaacgcacuaaucaaugaccagcugaucaugaagaaucauuugagagauaucaugggaauucccuacugcaauuacagcaaauacugguacuuaaaucauacuaagacagggaagacaucacugccaagaugcuggcuugugucaaaugguuccuaccugaaugagacacauuuuucugaugacauugaacaacaagcagacaacaugauaacagaacuguugcaaaaggaguacauggacagacaagggaaaacacccuuaggguuaguagaucuuuuugucuucagcaccagcuuuuaucuuauuagcaucuuccuccaccugguuaaaaucccaacccauagacaugucauagggaaacccugcccuaaaccacacagacucaaccacaugggcauaugcucauguggucuguacaaacauccugguguaccaguuaaguggaaaagauag

SEQ ID NO: 501 - RNA, 1473 nt, Artificial Sequence
  derived and/or modified CDS sequence (wt) from Lassa virus__AIT17588__GPC
auggggcaaaucauaacauuuuuccaggaagugccucaugucauugaggaggugaugaacauugucuuaauugcucucagucuucuagcaauacugaaagggauuuacaauguugcuaccuguggccucuuuggguugguguccuuucuucucuuauguggaaggucaugcucaacaacuuacaaggguguuuaugagcuucaaacucuagagcuggauauggcaagccuuaauaugacaaugcccuuauccugcacgaagaacaacagccaccacuacaucaugguuggaaaugagacuggcuuggagcugacuuugacaaacacaaguaucaucaaccacaaguucugcaaccuuuccgaugcacauaaaaagaaucucuaugaccaugcuuuaaugagcaucaucucaacuuuccaccuauccaucccuaacuuuaaucaguaugaagcaaugaguugugacuucaauggggggaagauaaguguucaguacaaccucagccacgcuuaugcuguagaugcagcuaaccauugugggaccauugccaauggaguucuucaaacuuuuaugaggauggcuugggguggcaguuacauagcacuugauucuggaaaggggaguugggauuguauaaugacuuccuaccaauauuugauaauccaaaacaccacuugggaagaucacugccaguuuucucgcccauccccuauugguuaucuggggcuacugucacaaagaaccagggauauuuacaucagccgaagacuccuuggaacuuuuacuuggacucucucugauucugaaggcaaugaaacaccggguggauauuguuuaacaagauggaugcugauugaggccgaauuaaagugcuuugggaacacagcaguugcgaaaugcaaugagaaacaugaugaagaguuuugugacauguuaagguuguuugacuuuaacaaacaggcuauaaggaggcuaaaggcagaagcacagaugagcauccaacuaauaaacaaagcagugaacgcacugaucaaugaccagcucauuaugaagaaucauuuaagagauaucaugggaauuccuuacugcaauuacagcaaguauugguauuuaaaucacacuguaacagggaagacaucguugccaagaugcuggcuuguaucaaaugguuccuaccugaaugaaacacauuuuucugaugacauugaacaacaagcagauaacaugauaacagaauuguuacagaaagaguacauugacaggcaagggaaaacacccuuaggguugguggaucuuuuugucuucagcacuagcuucuaccuuauuagcaucuuccuccaccugguuaaaaucccaacccacagacaugucauagggaagcccugccccaagccacacagacucaaccacaugggcauaugcucauguggucuguacaaacauccugguguaccagucaaguggaaaagauag

SEQ ID NO: 502 - RNA, 1473 nt, Artificial Sequence
  derived and/or modified CDS sequence (wt) from Lassa virus__AIT17592__GPC
augggacaaaucauaacauuuuuccaggaagugccucaugucauagaggaagugaugaacauuguccugauugcucucagccuucuggcaauauugaaagggaucuacaauguugcuaccuguggccucuuuggauugguguccuuccuccucuuauguggaagaucaugcucaacaacuuacaaggguguuuacgaacuacaaacccuugagcuagacauggcaagccuuaauaugacaaugccccugucuugcacgaagaacaauucccaccauuacaucauggucggaaaugagacuggcuuggaauugacuuuaacaaauacaagcauuaucaaccacaaguuuugcaaccuuucugaugcacauaaaaagaaucuuuaugaccacacuuuaaugaguaucaucucaaccuuccacuuauccauuccuaacuuuaaucaguaugaagcaaugaguugugacuucaaugggggaaggauaaguguucaguacaaccuuagccacgcuuaugcuguagaugcagccaaccacugugggaccauugccaauggcguucuccaaacuuuuaugaggauggcuugggguggcaguuacauagcacuugauucuggaaaggggagcugggauugcauaaugacuuccuaccaguauuuaauaauccaaaacaccacuugggaagaucauugucaguuuucucgcccaucccccaucgguuaucuggggcugcugucgcaaaggaccagggacauuuacaucagucgaagacuucuugggacuuuuacuuggacucucucugacucugaagguaaugaaacaccggguggauauugucuaacaagauggaugcugauugaggcugaguugaagugcuuugggaacacagcaguugcaaaaugcaaugagaaacaugaugaggaguuuugugacauguugagauuguuugacuuuaacaaacaagcuauaaggaggcugaagacagaagcacagaugagcauccaacugauaaacaaagcagugaacgcacugaucaaugaccagcugauuaugaagaaccauuugagagauaucaugggaauuccuuacugcaauuacagcaaauauugguaucuaaaucacacuauaacagggaaaacaucauugccaagaugcuggcuuguaucaaaugguuccuaccugaaugagacacauuuuucugaugacauugaacaacaagcagacaacaugauaacagaacuguugcaaaaggaguacauagacaggcaaggaaaaacacccuuaggguugguagaucuuuuugucuucagcaccagcuuuuaucuuauuagcaucuuccuccaccugguuaaaaucccaacccacagacaugucguagggaaacccugccccaaaccacauagacucaaucacaugggcauaugcucaugugguuuguacaaacauccuggugugccagucaaguggaaaagauag

SEQ ID NO: 503 - RNA, 1473 nt, Artificial Sequence
  derived and/or modified CDS sequence (wt) from Lassa virus__AIT17596__GPC
auggggcaaaucauaacauuuuuccaggaagugccucaugucauugaggaggugaugaacauugucuuaauugcucucagccuucuagcaauacuaaaagggauuuacaauguugcuaccuguggccucuuuggguugguguccuuucuucucuuauguggaaggucaugcucaacaacuuacaaggguguuuaugagcuucaaacucuggagcuggauauggcaagccuuaauaugacaaugcccuuauccugcacgaagaacaauagccaccacuacaucaugguuggaaaugagacuggcuuggagcugacuuuaacaaacacaaguaucaucaaccacaaguuuugcaaccuuucugaugcacauaaaaagaaucucuaugaccaugcuuuaaugagcaucaucucaaccuuccaccuauccaucccuaacuuuaaucaguaugaagcaaugaguugugauuucaauggggggaagauaaguguucaguacaaccucagccauacuuaugcuguggaugcagcuaaccauugugggaccauugccaauggaguccuucaaacuuuuaugaggauggcuugggguggcaguuacauagcacuugauucuggaaaggggaguugggauuguauaaugacguccuaccaauauuugauaauccaaaacacuaguugggaagaucacugccaguuuucucgcccguccccuaucgguuaucuggggcuacuuucacaaagaaccagggacauuuacaucagccgaagacuccuuggaaccuuuacuuggacucucucugauucugagggcaaugaaacaccggguggguauuguuuaacaagauggaugcugauugaagccgaauugaagugcuuugggaacacagcaguugcgaaaugcaaugagaaacaugaugaagaguuuugugacauguuaagguuguuugacuuuaauaaacaggccauaaggaggcuaaagacagaagcacagaugaguauccaacuaauaaacaaagcagugaaugcacugaucaaugaccagcucauuaugaagaaucauuuaagagauaucaugggaauuccuuacugcaauuacagcaaguauugguacuuaaaccacacuguaacagggaagacaucguugccaagauguuggcuuguaucaaaugguuccuaccugaaugaaacacauuuuucugaugacauugagcaacaagcagacaacaugauaacagaauuguuacagaaagaguacauugauaggcaagggaaaacacccuuaggguugguggaucuuuuuguuuucagcacuagcuucuaccuuauuagcaucuuccuccaccuggucaaaaucccaacccacagacaugucauagggaaacccugccccaagccacacagacucaaccacaugggcauaugcucauguggucuguacaaacauccugguguaccagucaaguggaaaagauag

SEQ ID NO: 504 - RNA, 1473 nt, Artificial Sequence
  derived and/or modified CDS sequence (wt) from Lassa virus__AIT17600__GPC
augggacaaaucauaacauuuuuccaggaaguaccucaugucauagaggaagugaugaacauuguccugauugcucucagucuucuagcaauacugaaggggaucuacaauguugcuaccuguggccucuuuggauugguguccuuccuccucuuauguggaagaucauguucaacaacuuacaaggguguuuaugagcuacaaacucuggagcuagacauggcaagccuuaauaugacaaugcccuuaucuugcacgaagaacaacagccaccauuacaucaugguuggaaaugagacuggcuuggagcugacuuuaacaaauacaaguaucaucaaccacaaauuuuguaaccucucugaugcacauaaaaagaaucuuuaugaucaugcuuuaaugaguaucauuucaaccuuccacuuauccauuccuaacuuuaaucaguaugaagcaaugagcugugacuucaauggggggaagauaaguguucaguacaaccuuagccacgcuuaugcuggagaugcagccaaccacuguggaacuaucgccaaugguguucuucagacuuuuaugaggauggcuugggguggcaguuauauagcacuugauuccggaaaggggaguugggacuguauaaugacuuccuaccaauauuugauaauccaaaacaccacuugggaggaucacugccaguuuucucgcccauccccuaucgguuaccuagggcuacugucacaaaggaccagggacauuuacaucagucgaagacuucuugggacuuucacuuggacucucucugauucugaagguaaugaaacaccggguggguauugucuaacaagauggaugcugauugaggccgaguugaaaugcuuugggaacacagcaguugcgaaaugcaaugagaaacaugaugaagaguuuugugacauguuaagauuguuugacuuuaacaaacaagcuauaaggaggcuaaagacagaagcacagaugaguauccagcugauaaacaaagcagugaacgcacugaucaaugaccagcugauuaugaagaaucauuugagagauaucauggggauuccuuacugcaauuacagcaaguacugguaucuaaaucauacuguaacagggaagacaucguugccaaggugcuggcuugugucaaaugguucauaccugaaugagacacauuuuucugaugacauugaacaacaagcagacaauaugauaacagaacugcugcaaaaggaguacauagacaggcaagggaaaacaccuuuaggguuaguagaucuuuuugucuucagcaccagcuuuuaccucauuagcaucuuccuccaccugguuaaaaucccaacccacagacaugucauaggaaaacccugcccuaaaccacacagacuuaaccacaugggcauauguucauguggucuauacaaacauccuggugugccagucaaguggaaaagauag

SEQ ID NO: 505 - RNA, 1473 nt, Artificial Sequence
  derived and/or modified CDS sequence (wt) from Lassa virus__AIT17604__GPC
augggacaaaucauuacauuuuuccaggaaguaccucaugucauagaggaagugaugaacauuguucugauugcucucagccuucuggcaauacugaaggggaucuacaauguugcuaccuguggccuuuuuggauugguguccuuucuccucuuauguggaagaucaugcucaacaaccuauaaggguguuuaugagcuacaaacucuagagcuggacaugacaagccucaauaugacaaugcccuuaucuugcacgaagaacaauagccaccauuacaucauggucgggaaugagacuggcuuagagcugacuuuaacaaauacaaguaucaucaaccacaaguuuuguaaccuuucugaugcacauaaaaaagaucuuuaugaccaugcuuuaaugaguaucaucucaaccuuccacuuaucuaucccuaacuucaaucaauaugaggcaaugaguugugacuucaauggggggaagauaaguguucaguacaaccuuagccacacuuacgcuguagaugcagcuaaacacugugggaccaucgccaacggcguucuucagacuuucaugagaauggcuugggguggcaguuacauagcacuugauuccggaaaggggaguugggauugcauaaugaccuccuaccaauauuugauaauccaaaacacuacuugggaagaucacugccaguuuucucgcccauccccugucgguuaucuggggcugcuaucacaaaggaccagggacauuuacaucagucgaagacuucuugggacuuuuacuuggacucucucugauucugaagguaaugaaacaccggguggguauugucuaacaagauggaugcugauugaggccgaguugaaaugcuucgggaacacagcaguugcuaaaugcaaugagaaacaugaugaagaguucugugacauguuaagauuguuugacuucaacaaacaagcuauaaggagacugaagacagaagcacagaugaguauccaacugauaaacaaagcaguaaacgcacugaucaaugaccagcugaucaugaagaaucauuugagagauaucaugggaauuccuuacugcaauuauaguaaguacugguaucuaaaucacacuguuacagggaagacaucguugccaagaugcuggcuugugucaaaugguuccuaccugaaugagacacauuuuucugaugacauugaacaacaagcagacaacaugauaacagaacuguugcaaaaagaguacuuagacaggcaagggaaaacacccuuaggguuaguagaucuguuugucuucagcaccagcuuuuaucucauuagcaucuuccuccaccugguuaaaaucccaacccacagacaugucauagggaaacccugcccuaaaccacacagacucaaccacaugggcauaugcucauguggucuguacaaacacccuggugugccagucaaguggaaaagauag

SEQ ID NO: 506 - RNA, 1473 nt, Artificial Sequence
  derived and/or modified CDS sequence (wt) from Lassa virus__AIT17608__GPC
augggacaaaucauaacauuuuuccaggaaguaccucaugucauagaggaagugaugaacauuguccugauugcucucagccuucuggcaauacugaaagggaucuacaauguugcuaccuguggccucuuuggauugguguccuuucuccucuuauguggaagaucaugcucaacaacuuacaaggguguuuaugagcuacaaacuuuagagcuagacauggcaagccuuaacaugacaaugcccuugucuugcacgaagaacaacucccaccauuacaucauggucggaaaugagacuggccuggagcugacuuuaacaaauacaagcaucaucaaccacaaguuuuguaaccuuucugaugcacauaaaaggaaucuuuauaaccaugcuuuaaugaguaucaucucaaccuuccacuuauccauuccuaacuuuaaucaguaugaagcaaugagcugugacuucaaugggggaaagauaaguguucaguacaaucuuagccacacuuaugcuguagaugcagcuaaccacugugggaccauugccaauggcguucuucagacuuuuaugaggauggcuugggguggcaguuacauagcacuugauuccggaaaggggagcugggauugcauaaugacuuccuaccaauauuugauaauccagaacacuacuugggaagaucacugccaguuuucucgcccaucccccaucgguuaucugggguugcugucacaaaggaccagggacauuuacaucagucgaagacuucuuggaacuuucacuuggacucucucugacucugaagguaaugaaacaccggguggguauuguuuaacaagauggaugcugauugaagccgaauugaagugcuuugggaacacagcaguugcaaaaugcaaugagaaacaugaugaagaauuuugugacauguuaagauuguuugauuuuaacaaacaagcuauaaggaggcugaagacagaagcacagaugaguauucaacugauaaacaaagcagugaacgcacugauuaaugaccagcugauuaugaagaaucauuugagagauauuaugggaauuccuuacugcaauuacagcaaguauugguaucuaaaucacacugucacagggaagacaucauuaccaagaugcuggcuugugucaaaugguucuuaccugaaugagacacauuuuucugaugacauugaacaacaagcagacaacaugauaacagaacuguugcaaaaggaguacauagacaggcaagggaaaacacccuuaggguuaguagaccuuuuugucuucagcaccagcuuuuaucucaucagcaucuuccuccaccugguuaaaaucccaacccauagacauaucauagggaaacccugcccuaaaccacacagacucaaccauaugggcauauguucauguggucuguacaaacauccuggugugccagucaaguggagaagauag

SEQ ID NO: 507 - RNA, 1473 nt, Artificial Sequence
  derived and/or modified CDS sequence (wt) from Lassa virus__AIT17612__GPC
augggacaaaucauaacauuuuuccaggaaguaccucaugucauagaggaagugaugaacauuguccugauugcucuuagccuuuuggcaauacugaaagggaucuacaauguugcuaccuguggucucuuuggauugguguccuuucuccucuuauguggaagaucauguucaacaacuuacaaggguguuuaugagcuacaaacucuagagcuagacauggcaagccuuaacaugacaaugcccuugucuugcacgaagaacaacucccaccauuacaucagggucggaaaugagacuggcuuggagcugaccuuaacaaacacaagcauuauuaaccacaaguuuuguaaccuuucugaugcacacaaaaagaaucuuuaugaccauucuuugaugaguaucaucucaaccuuccacuuauccauuccuaacuuuaaucaguaugaagcaaugaguugugacuucaauggggggaagauaaguguucaguacaaccuuagccacaccuaugcuguggaugcggcuaaccacugcgggaccauugccaauggcguucuucagacuuuuaugaggauggcuugggguggcaguuacauagcacuugauuccggaaaggggaacugggauugcauaaugacuuccuaccaauauuugauaauccaaaacaccacuugggaagaucacugucaguuuucucgcccaucccccaucggcuaucuggggcuguugucacaaaggaccagggacauuuacaucagucgaagacuucuugggacuuuuacuuggacucucucugacucugaagguaaugaaacaccggguggguauugucuaacaagauggaugcugauugaggccgaguugaagugcuuugggaacacagcaguugcaaaaugcaaugagaaacaugaugaggaauuuugugacauguuaagauuguuugacuucaauaaacaagccauaaggagacugaagacagaagcacagaugaguauccaacugauaaacaaagcagugaacgcacugaucaaugaccagcugauuaugaagaaucacuugagagauaucauggggauuccuuacugcaauuacagcaaguauugguaucuaaaucacacuguaacagggaagacaucgcuuccaagaugcuggcuugugucaaaugguuccuaccuaaaugagacacauuuuucugaugacauugaacaacaagcggacaauaugauaacugaacuguugcagaaggaguacauagacaggcaaggaaaaacacccuugggguuaguagaucuuuuugucuucagcaccagcuuuuaucucauuagcaucuuccuccaccugguuaaaaucccaacccacagacaugucguggggaaacccugcccuaaaccacacagacucaaccacaugggcauaugcucauguggucuguacaaacauccuggugugccagucaaguggaaaagauag

SEQ ID NO: 508 - RNA, 1473 nt, Artificial Sequence
  derived and/or modified CDS sequence (wt) from Lassa virus__AIT17616__GPC
augggacaaaucauaacauuuuuccaggaaguaccucaugucauagaggaagugaugaacauuguccugauugcucucagucuucuggcaauacugaaggggaucuacaauguugcuaccuguggccucuuuggauugguauccuuucuccucuuauguggaagaucaugcucaacaacuuacaaggguguuuaugagcuacaaacucuagagcuagacauggcaagccuuaacaugacaaugcccuuaucuugcacgaaaaacaacucccaccauuacaucauggucggaaaugagacuggcuuggagcugaccuuaacaaauacaagcaucaucaaccacaaguuuuguaaccuuucugaugcacauaaaaagaaucucuaugaccaugccuugaugaguaucaucucaaccuuccacuuauccauuccuaacuuuaaucaguacgaagcaaugaguugugacuucaaugggggaaagauaaguguucaguacaaccuuagccacgccuaugcuguagaugcagccaaucacugugggaccauugccaauggcguucuucagacuuucaugaggauggccugggguggcaguuacauagcacuugauuccggaaaggggagcugggauugcauaaugacuuccuaccaauauuugauaauccaaaauaccacuugggaagaucacugccaguucucccgcccaucccccaucggcuaucugggguugcugucacaaaggaccagggacauuuacaucaguagaagacuucuugggaccuuuacuuggacucucucugacucugaagguaaugagacaccggguggguauugucuaacaagauggaugcuaauugaggcugaguugaagugcuuugggaacacagcaguugcaaagugcaaugagaaacaugaugaagaguuuugugacauguugagauuguuugacuucaacaaacaagcuauaaggagacugaaaacagaagcacagaugaguauccaacugauaaacaaagcagugaacgcacugaucaaugaccagcuuauuaugaagaaucacuugagggauaucaugggaauuccuuacugcaauuacaguaaauauugguaucuaaaccacacuguaacagggaagacaucgcugccaagaugcuggcuugugucaaaugguuccuaccugaaugagacacauuuuucugaugacauugaacaacaagcagacaacaugauaacagaacuguugcaaaaggaguacauagacaggcaagggaaaacacccuuaggguuaguagaucuuuuugucuucagcaccagcuucuaucucauuagcaucuuucuccacuugguuaaaaucccaacccacagacaugucauagggaaacccugcccuaaaccacacagacucaaccacaugggcauaugcucauguggucuguacaaacauccuggugugccagucaaguggaagagauag

SEQ ID NO: 509 - RNA, 1473 nt, Artificial Sequence
  derived and/or modified CDS sequence (wt) from Lassa virus__AIT17620__GPC
augggacaaaucauaacauuuuuccaagagguaccucaugucauagaggaagugaugaacauuguccugauugcucucagccuucuggcaauacugaaagggaucuacaauguugcuaccuguggccucuuuggguugguguccuuucuccucuuauguggaagaucaugcucaacaacuuacaaggguguuuaugagcuacaaacucuagagcuagacauggcaagccuuaauaugacaaugcccuugucuugcacgaagaacaacucccaccauuacaucauggucggaaaugagacuggccuggagcuaacuuuaacaaauacaagcauuaucagccacaaguucuguaaccuuucugaugcacauaaaaagaaucuuuaugaccaugcuuuaaugaguauuaucucaaccuuucacuuauccauuccuaacuuuaaucaguaugaagcaaugaguugugacuucaauggggggaagauaaguguucaguacaaccuuagccaugcuuaugccauagaugcagcuaaccacugugggaccguugccaauggcguucuacagacuuuuaugaggauggcuugggguggcaguuacauagcacuugauuccggaaaagggagcugggauugcauaaugacuuccuaccaauauuuaauaauccaaaacaccacuugggaagaucacugccaguuuucucgcccaucccccaucgguuaucuggggcuacugucacaaaggaccagggacauuuacaucagucgaagacuucuugggacuuucacuuggacucucucugacucugaggguaaugaaacaccggguggauauugucuaacaagauggaugcugauugaggccgaguugaagugcuuugggaacacagcaguugcaaaaugcaaugagaaacacgaugaagaguuuugugacauguuaagauuguuugacuuuaacaaacaagccauaagaaggcugaaggcagaagcacaaaugaguauccaacugauaaacaaagcagugaacgcacugaucaaugaccagcugauuaugaagaaucauuugagagauaucaugggaauuccuuacugcaauuacagcaaguauugguaucuaaaucacacuguaacagggaagacaucacugccaagaugcuggcuugugucaaauggguccuaccugaaugagacacauuuuucugacgacauugaacaacaagcagacaacaugauaacagaacuguugcaaaaggaguacauggacagacaagggaaaacacccuuaggguuaguugaucuuuuugucuucagcaccagcuuuuaucucauuagcaucuuccuccaccugguuaaaauuccaacccacagacaugucauagggaaacccugcccuaaaccacacagacucaaccauaugggcauaugcucaugugguuuguacaaacauccuggugugccagucaaguggaaaagauag

SEQ ID NO: 510 - RNA, 1473 nt, Artificial Sequence
  derived and/or modified CDS sequence (wt) from Lassa virus__AIT17626__GPC
augggacaaaucauaacauuuuuccaggaaguaccucaugucauagaggaagugaugaacauugucuugauugcucuuagccuucuggcaauacugaaaggagucuacaauguugcuaccuguggccucuuuggauugguguccuuucuccuccuauguggaagaucaugcucaacaacuuacaaggguguuuaugagcuacaaacucuagagcuagauauggcaagccuuaauaugacaaugcccuuaucuugcacgaagaacaacucccaccacuacaucaugguuggaaaugaaacuggcuuggagcugacuuuaacaaacacaaguauuauccagcacaaguuuuguaaccuuucugaugcacauaaaaagaaucuuuaugaccaugcuuuaaugagcaucaucucaaccuuccauuuauccauuccaaacuuuaaucaguaugaagcaaugagcugugacuucaauggagggaagauaacuguucaguacaaccuuagccacucuuaugcuauagaugcagcaaaccacugugggacuauugccaauggcguucuucagacuuuuaugaggauggcuugggguggcaguuacauagcacuugauucuggaaagggaagcugggauugcauaaugacuuccuaccaauauuugauaauccaaaacaccacuugggaagaucacugccaguuuucucgcccaucccccaucgguuaucuggggcuacugucacaaaggaccagggacauuuacaucagucgaagacuucuugggacuuuuacuuggacucucucugauucugaagguaaugaaacaccggguggguauugucuaacaagguggaugcugauugaggcagaguuaaagugcuuugggaacacagcaguugcgaaaugcaaugagaaacaugaugaagaguuuugugacauguugagauuguuugacuuuaacaaacaagcuauaaggaggcugaagacagaagcacaaaugaguauccaacugauaaacaaagcagugaacgcacugaucaaugaccagcugauuaugaagaaucauuugagggauauuaugggaauuccuuacugcaauuacagcaaguauugguaucuaaaucacacuguaacagggaggacaucguugccaagaugcuggcuugugucaaaugguuccuaccuaaaugagacacauuuuucugaugacauugaacaacaagcagauaacaugauaacagaacuguugcaaaaggaguacauggacaggcaagggaaaacacccuuaggguuaguagaucuuuuugucuucagcaccagcuuuuaucucauuagcaucuuccuccaccugguuaaaaucccaacccacagacacaucauagggaaacccugcccuaaaccacacaggcucaaccacaugggcguaugcucauguggucuguacaaacacccuggugugccagucaaguggaaaagauag

SEQ ID NO: 511 - RNA, 1473 nt, Artificial Sequence
  derived and/or modified CDS sequence (wt) from Lassa virus__AIT17630__GPC
auggggcaaaucauaacauuuuuccaagaagugccucaugucaucgaggaagugaugaacauuguccuaauugcucucagccuucuagcaauacuaaaagggauuuacaauguugcuaccuguggccucuuuggguugcuguccuuucuucucuuauguggaaggucaugcucaacaacuuacaaggguguuuaugagcuucaaacucuggagcuggauauggcaagccucaauaugacaaugcccuuauccugcacgaagaacaacagccaccacuacaucaugguuggaaaugagacuggcuuggagcuaacuuuaacaaacacaaguaucaucaaccacaaguucugcaaccuuucugaugcacauaaaaagaaucucuaugaccaugcuuuaaugagcaucaucucgaccuuccacuuauccaucccuaacuuuaaucaguaugaagcaaugaguugugacuucaaugggggaaagauaaguguucaguacaaccucagccaugcuuaugcuguggaugcagcugagcauugugggaccauugccaauggaguccuucaaacuuuuaugaggauggcuugggguggcagcuacauagcacuugauucuggaaaggggaguugggauuguguaaugacguccuaccaauauuugauaauccaaaacaccaguugggaagaucacugccaguuuucucgcccguccccuaucgguuaucuggggcuacugucacaaagaaccagggacauuuacaucagucgaagacuccuuggaacuuuuaccuggacucucucugauucugagggcaaugaaacaccggguggguauuguuuaacaagauggaugcugauugaggccgaauuaaagugcuuugggaacacagcaguugcgaaaugcaaugagaaacaugaugaagaguuuugugacauguuaagguuguuugacuuuaacaaacaggcuauaaggagguuaaagacagaagcacagaugaguauccaacuaauaaacaaagcagugaacgcacugaucaaugaccagcucauuaugaagaaucauuuaagagauaucaugggaauuccuuacugcaauuacagcaaguauugguauuuaaaccauacuguaacagggaagacaucguugccaagaugcuggcuuguaucaaaugguuccuaccugaaugaaacacauuuuucugaugacauugagcaacaagcagacaacaugauaacagaauuguugcagaaagaguacauugacaggcaagggaaaacacccuuaggguugguggaucuuuuugucuucagcacuagcuuuuaccuuauuagcaucuuccuccaccuggucaaaaucccaacccacagacaugucauagggaaacccugccccaagccacacagacucaaccacaugggcauaugcucauguggucuguacaaacauccugguguaccagucaaguggaaaagauag

SEQ ID NO: 512 - RNA, 1473 nt, Artificial Sequence
  derived and/or modified CDS sequence (wt) from Lassa virus__AIT17634__GPC
augggacaaaucauaacauuuuuccaggaaguaccucaugucauagaggaagugaugaacauuguucugauugcucucagccuucuggcgauacugaaggggaucuacaauguugcuaccuguggccucuuugggcugguguccuuucuccucuuaugugggagaucauguucaacaauuuacaaggauguuuaugagcuacaaacccuagagcuggauauggcaagccucaacaugacaaugcccuuaucuugcacgaagaacaacagccaccauuacaucaugguuggaaaugagacuggcuuggaacugacuuuaacaaauacaaguauuaucaaccacaaguuuuguaaccuuucugaugcgcauaaaaagaaucuuuaugaccaugcuuuaaugaguaucaucucaaccuuccacuuauccauuccuaacuucaaucaguaugaagcaaugaguugugacuuuaaugggggaaagauaaguguucaguacaaccuuagccacacuuaugcuauagaugcagcuaaccacugugggacuaucgcuaauggcguucuucagacuuucaugaggauggcuugggguggcaguuacauagcacuugauuccggaaaggggaguugggauuguauaaugacuuccuaccaauacuugauaauccaaaacaccacuugggaagaucacugccaguuuucucgcccauccccuauugguuaucugggcuuacugucgcaaaggaccagggacauuuacaucagucgaagacuucuugggacuuuuacuuggacccucucugauucugaagguaaugaaacaccggguggguauugucuaacaagauggaugcugauugaggccgaguugaagugcuuugggaacacagcagucgcgaaaugcaaugaaaaacaugaugaagaguuuugugacauguuaagauuguuugacuuuaacaaacaagcuauaaggaggcugaagacggaagcacagaugaguauccaacugauaaacaaagcagugaacgcauugaucaaugaucagcugauuaugaaaaaucauuugagagauaucaugggaauuccuuacugcaauuacagcagguauugguaucuaaaucacacugugacagggaggacaucguugccaaggugcuggcuugugucaaacgguuccuaccugaaugagacacauuuuucugaugacauugaacagcaagcagacaacaugauaacagaacuguugcaaaaggaguacauggacagacaagggaaaacacccuuaggguuaguggaucuuuuugucuucagcaccagcuuuuaucucauuagcaucuuccuccaccugguuaaaaucccaacccacagacaugucauagggaaacccugcccuaaaccacauagacucaaccacaugggcauaugcucauguggucuauacaaccauccuggugugccagucaaauggaaaagauag

SEQ ID NO: 513 - RNA, 1473 nt, Artificial Sequence
  derived and/or modified CDS sequence (wt) from Lassa virus__AIT17638__GPC
augggacaaaucauaacauuuuuccaggaaguaccucaugucauagaggaagugaugaacauuguccugauugcucucagccuucuggcaauacugaaggggaucuacaauguugccaccuguggccuauuuggacugguguccuuucuccucuuauguggaagaucaugcucaacaacuuauaaggguguuuaugagcuacaaacucuagagcuggauauggcaagccuuaauaugacaaugccccuaucuugcacaaagaacaacagucaccauuacaucauggucggaaaugagacuggcuuggagcugacuuuaacaaauacaaguauuaucaaccacaaguuuuguaaccuuucugaugcacauaaaaaggaucucuaugaccaugcuuuaaugaguaucaucucaaccuuccacuuaucuauuccuaauuuuaaucaguaugaagcaaugaguugugacuucaauggggggaagauaaguguucaguacaaccuuagccacacuuaugcuguagaugcagccaaucacugugggacuaucgccaauggcguucuucagacuuuuaugaggauggcuugggguggcaguuacauagcacuugauuccggaaaggggaguugggauuguauaaugacuuccuaccaauauuugauaauccagaacaccacuugggaagaucacugccaguuuucucgcccauccccuaucgguuaucuggggcuacugucacaaaggaccagagacauuuacaucagucgaagacuucuugggacuuuuacuuggacucucucugauucugaagguaaugaaacaccggguggguacugucuaacaagauggaugcugauugaggccgaguugaagugcuuugggaacacagcaguugcgaaaugcaaugagaaacaugaugaagaguuuugugacauguuaagacuguuugauuucaacaaacaagcuauaaggaggcuaaagacagaagcacagaugaguauccaacugauaaacaaagcagugaaugcauugaucaaugaccagcuuauuaugaagaaucacuugagagauaucaugggaauuccuuacugcaauuacagcaaguacugguaucugaaucacacuguaacagggaagacaucguugccgaggugcuggcuugugucaaaugguuccuaccugaaugagacacauuuuucugaugacauugaacaacaggcagacaacaugauaacagaacuguugcaaaaggaguacauggacaggcaagggaaaacacccuuaggguuaguagaccuuuuugucuucagcaccagcuuuuaucucauuagcaucuuccuccaccugaucaaaaucccaacccacagacauaucacagggaaacccugcccuaaaccacacagacuuaaccacaugggcauaugcucauguggucuauacaaacauccugguguaccagucaaguggaaaagauag

SEQ ID NO: 514 - RNA, 1473 nt, Artificial Sequence
  derived and/or modified CDS sequence (wt) from Lassa virus__AIT17642__GPC
augggacaaaucauaacauuuuuccaagaaguaccucaugucauagaggaagugaugaacauuguccugauugcccucagccuccuggcaauacugaaaggggucuacaauguugccaccuguggccucuuuggacugguguccuuucuccucuuauguggaagaucaugcucaacaacuuacaaggguguuuaugagcuacagacucuagagcuagacauggcaagccuuaauaugacaaugcccuuaucuugcacgaagaacaacagccaucauuacaucauggucggaaaugauacuggcuuggagcugacuuuaacaaauacaaguauuaucaaccacaaguucugcaaccuuucugaugcacacaaaaagaaucuuuaugaccaugcuuuaaugaguaucauuucaaccuuccacuuaucuauuccuaacuuuaaucaguaugaagcaaugaguugugacuucaaugggggaaagauaaguguucaauacaaccuuagccacgcuuaugcuguagaugcagcuagccacugugggaccauugccaauggcguucuucagacuuuuaugaggauggcuugggguggcaguuacauagcacuugauuccgguaaggggaguugggauuguauaaugacuuccuaccaauauuugauaauccaaaacacuacuugggaagaucacugccaguuuucccgcccauccccuaucgguuaccuggggcuacugucacaaaggaccagggacauuuacaucagucgaagacuucuugggacuuuuacuuggacucucucugauucugaggguaaugaaacaccggguggguauugucugacaagauggaugcuaauugaggccgagcugaagugcuuugggaacacagcaguugcaaaaugcaaugagaaacaugaugaagaguuuugugacauguuaagguuguuugacuuuaacaagcaagcuauaaggagacugaagacagaagcgcagaugaguauccaauugauaaacaaagcagugaacgcacugauaaaugaccaacugaucaugaagaaucauuugagagauaucaugggaauuccuuacugcaauuacagcaaguacugguaccuaaaucacacuguaacagggaaaacaucguugccaagaugcuggcuugugucaaaugguuccuaccugaaugagacacauuuuucugaugacauugaacaacaagcagacaacaugauaacagaacuguugcaaaaggaguacauggacaggcaagggaaaacacccuuaggguuaguagaucuuuuugucuucagcaccaguuuuuaucucauuagcaucuuccuccaccuaguuaaaaucccaacccauagacauauuauagggaaacccugcccuaaaccacacagacucaaccacaugggcauaugcucauguggucuguacaaacauccugguguaccaguuaaguggaaaagauag

SEQ ID NO: 515 - RNA, 1473 nt, Artificial Sequence
  derived and/or modified CDS sequence (wt) from Lassa virus__AIT17646__GPC
auggggcaaaucauaacauucuuccaggaaguaccucaugucauagaggaagugaugaacauuguccugauugcccucagccuucuggcaauauugaaaggaaucuacaauguugcuaccuguggccucuuuggauugguguccuuucuccucuuauguggaagaucaugcucaacaacuuacaaagguguuuaugagcugcaaacucuagaacuagacauggcaagccuuaauaugacaaugcccuuaucuugcacaaagaauaacagccaucauuacaucauggucgggaaugagacuggcuuagagcugaccuuaacaaauacaaguaucauuaaccacaaguuuuguaaccucucugaugcacauaaaaagaaucuuuaugaccaugcuuuaaugaguaucaucucaacuuuccacuuauccauuccuaauuuuaaucaguaugaagcaaugaguugugacuucaauggggggaagauaaguguucaguacaaccuuagccacgcuuaugcuguagaugcagccagccacugugggaccguugccaauggcguucuucagacuuucaugaggauggcuugggguggcaguuacauagcacuugauuccgggaaagggaguugggauuguauaaugacuuccuaccaauauuugauaauccagaacaccaccugggaagaccacugccaguuuucucguccaucccccaucgguuaucuggggcuacugucacaaaggaccagggacauuuacaucagucgaagacuccuugggacuuuuacuuggacccucucugauucugaaggcaaugagacaccggguggauauugucuaacaagauggaugcugauugaggccgaauugaagugcuuugggaacacagcaguugcgaagugcaaugagaaacaugaugaagaguuuugugacauguuaagauuguuugacuuuaacaaacaagcuauaaggaggcugaagacagaagcacagaugaguauccaacugauaaacaaagcagugaacgcacugaucaacgaccagcugauuaugaagaaucauuuaagagauaucaugggaauuccuuacugcaauuacagcaaauauugguauuuaaaucacacuguaacagggaagacaucguugcccagaugcuggcuugugucaaaugguuccuaccugaaugagacacauuuuucugaugacauugaacaacaagcagacaacaugauaacagaacuguugcagaaggaguacauggacaggcaagggaaaacacccuuaggguuaguagaucuuuuugucuuuagcaccagcuuuuaucucauuagcaucuuccuccaccugguuaaaaucccaacucacagacaugucauagggaaacccugcccuaaaccacacagacucaaccacaugggcauaugcucauguggucuguacaaacauccugguguaccagucaaauggaaaagauag

SEQ ID NO: 516 - RNA, 1473 nt, Artificial Sequence
  derived and/or modified CDS sequence (wt) from Lassa virus__AIT17650__GPC
auggggcaaaucauaacauuuuuucaggaagugccucaugucauagaagaagugaugaacauuguccugauugcccucagccuucuggcaauauugaaagggaucuacaauguugcuacuuguggccucuuuggacugguguccuuucuucucuuauguggaagaucaugcucaacaacuuacaaagguguuuaugagcuacaaacucuagagcuagacauggcaagccuuaauaugacaaugcccuuaucuugcacaaagaauaauagccaccauuacaucauggucggaaaugaaacuggcuuagagcugacuuuaacaaauauaaguaucaucaaccacaaguuuuguaaccuuucugaugcacauaaaaagaaucuuuaugaccaugcuuuaaugagcaucaucucaaccuuccacuuauccauuccuaacuucaaucaauaugaagcaaugaguugugacuucaauggggggaagauaaguguucaguacaaccuuagccacacuuaugcuguagaugcagcuaaccacugugggaccauugccaauggcguucuucagacuuucaugaggauggcuugggguggcagcuacauagcacuugauuccggaaaagggaguugggauuguauaaugacuuccuaccaauauuugauaauccagaacaccacuugggaagaucacugccaguuuucucgcccaucccccaucgguuaucuggggcuacugucacaaaggaccagggacauuuacaucagucgaagacuccuugggacuuuuacuuggacccucucugauucugaaggcaaugaaacuccagguggguauugucuaacaagguggauguugauugaggccgaguugaagugcuucgggaacacagcaguugcgaaaugcaaugagaaacaugaugaagaguuuugugacaugcuaagauuguuugacuucaauaaacaagcuauaaggagacugaaagcagaagcacagaugaguauccaacuaauaaacaaagcagugaaugcacugaucaaugaccagcugauaaugaagaaucauuuaagagauaucaugggaauuccuuacugcaauuacagcaaguauugguauuugaaucacacuguaacaggaaggacaucguuaccaagaugcuggcuugugucaaaugguuccuaccugaaugagacacauuuuucugacgacauugaacaacaagcagacaacaugauaacagaacuguugcagaaggaguacauagacaggcaagggaaaacaccuuuaggguuaguagaucuuuuugucuucagcaccagcuuuuaucucaucagcaucuuccuccaccugguuaaaaucccaacccacagacauaucauagggaaacccugcccuaaaccacacagacucaaccacaugggcauaugcucauguggucuguacaagcauccuggugugccagucaaguggaaaagauag

SEQ ID NO: 517 - RNA, 1473 nt, Artificial Sequence
  derived and/or modified CDS sequence (wt) from Lassa virus__AIT17658__GPC
augggacaaaucauaacauucuuucaggaaguaccucaugucauugaggaagugaugaacauuguccugauugcccucagccuucuagcaauacugaaagggguuuacaauguugcuaccuguggccucuuuggauugguguccuuucuccucuuauguggaaggucaugcucaauaacuuacaaggguguuuaugagcuacaaacucuagagcuagacauggcaaaccuuaauaugacaaugcccuuaucuugcacgaagaacaacagccaucauuacaucauggucggaaaugagacuggcuuagagcugacuuuaacaaauacaaguaucaucaaccacaaguuuuguaaccuuucugaugcacauaaaaagaaucuuuaugaccaugcuuuaaugaguaucaucucaaccuuccacuuauccauuccuaacuuuaaucaguaugaggcaaugaguugugacuucaaugggggaaagauaaguguucaguacaaccucagccacacuuaugcuggagaugcagcugaccacugugggaccauugccaauggcguucuucagacuuuuaugagaauggcuugggguggcaguuacauagcacuugauucuggaaaggggaguugggauuguauaaugacuuccuaccaauauuugauaauccaaaacaccacuugggaagaucacugccaguuuucccgcccauccccuauggguuaucugggguugcugucacaaaggaccagggauauuuacaucagucgaagacuccuuggaacuuuuacuuggacucucucugauucugaagguaaugaaacaccggguggguauugucuaacaagauggaugcugauugaggcagaguugaagugcuuugggaacacagcaguugcgaaaugcaaugagaaacaugaugaagaguuuugugacauguuaagguuguuugauuucaacaaacaagcuauaaggaggcugaagacagaggcacaaaugagcauucaacugauaaacaaagcagugaacgcacugaucaaugaccagcuaaucaugaagaaucauuugagagauaucaugggaauuccuuacugcaauuacagcaaguauugguaucuaaaucacacuauaacagggaaaacaucguugccaagaugcuggcuugugucaaaugguuccuaccugaaugaaacacauuuuucugaugacauugaacaacaagcagacaacaugauaacagaacuguugcagaaggaguacauagacagacaagggaaaacacccuuaggguugguggaucucuucgucuucagcaccagcuuuuaucucauuagcaucuuccuccacuugguuaaaaucccaacucacaggcauaucacagggaaacccugcccuaaaccacacagacucaaccacaugggcauaugcucaugugguuuguacaaacaucccgguguaccaguuagauggaaaagauag

SEQ ID NO: 518 - RNA, 1473 nt, Artificial Sequence
  derived and/or modified CDS sequence (wt) from Lassa virus__AIT17666__GPC
auggggcagaucguaacauuuuuccaggaaguaccucaugucauagaagaggugaugaacauuguccugauugcccucagccuucuggcaauauuaaaagggaucuacaauguugcuaccuguggucucuuuggauugguguccuuucuucucuuauguggaagaucaugcucaacaacuuacaaagguguuuaugagcuacaaacucuagagcuagacauggcaagccuuaauaugacaaugcccuuauccugcacgaagaacaacagccaucauuacaucauggucggaaaugagacuggcuuagagcugaccuuaacgaauacaaguaucaucaaccacaaguuuuguaaccuuucugaugcacauaaaaagaaucuuuaugaccaugcuuuaaugaguaucaucucaaccuuccacuuauccauuccuaacuuuaaucaguaugaagcaaugagcugugacuucaauggggggaagauaaguguucaguacaaccuuagccacacuuaugcuguagaugcagcuaaccacugugggaccauugccaauggcguucuucagacuuucaugaggauggcuugggguggcaguuacauagcacuugauuccggaaaagggaguugggauuguauaaugacuuccuaccaauauuuaauaauccagaacaccacuugggaagaucacugccaguuuucucguccaucccccaucgguuaucuggggcuacugucacaaagaaccagggacauuuacaucagucgaaggcuccuugggacuuuuacuuggacccucucugauucugaaggcaaugaaacaccggguggguauugucuaacaagauggaugcugauugaggccgaguuaaagugcuuugggaacacagcaguugcaaaaugcaaugagaaacaugaugaagaguuuugugacauguuaagacuguuugauuucaacaaacaagcuauaaggaggcugaagacagaagcacagaugaguauccagcuaauaaacaaagcagugaacgcacugaucaaugaccagcugauuaugaagaaucaucuaagagauaucaugggaauuccuuacugcaauuacagcaaguauugguauuuaaaucacacuguaacagggaagacaucguugccaagaugcuggcuugugucaaaugguuccuaccugaaugagacacauuuuucugaugacauugaacaacaagcagacaacaugauaacagaacuguugcagaaggaguacauggacaggcaagggaaaacacccuuaggguuaguagaucuuuuugucuucagcaccagcuuuuaucucauuagcaucuuccuccaccugguuaaaaucccaacccacagacauaucacaggaaaacccugccccaagccacacagacucaaccacaugggcauaugcucauguggucuguacaaacauccugguguaccagucaaguggaaaagauag

SEQ ID NO: 519 - RNA, 1473 nt, Artificial Sequence
  derived and/or modified CDS sequence (wt) from Lassa virus__AIT17670__GPC
auggggcaaaucauaacauuuuuucaggaagugccucaugucauagaagaagugaugaacauuguccugauugcccucagccuucuggcaauauugaaagggaucuacaauguugcuacuuguggccucuuuggacugguguccuuucuucucuuauguggaagaucaugcucaacaacuuacaaagguguuuaugagcuacaaacucuagagcuagacauggcaagccuuaauaugacaaugcccuuaucuugcacaaagaauaauagccaccauuacaucauggucggaaaugaaacuggcuuagagcugacuuuaacaaauacaaguaucaucaaccacaaguuuuguaaccuuucugaugcacauaaaaagaaucuuuaugaccaugcuuuaaugagcaucaucucaaccuuccacuuauccauuccuaacuucaaucaauaugaagcaaugaguugugacuucaauggggggaagauaaguguucaguacaaccuuagccacacuuaugcuguagaugcagcuaaccacugugggacuauugccaauggcguucuucagacuuuuaugaggauggcuugggguggcagcuacauagcacuugauuccggaaaagggagcugggauuguauaaugacuuccuaccaauauuugauaauccagaacaccacuugggaggaucacugccaguuuucucgcccaucccccaucgguuaucuggggcuacugucacaaaggaccagggacauuuacaucagucgaagacuccuuggaacuuuuacuuggacccucucugauucugaaggcaaugaaacuccagguggguauugucuaacaagguggauguugauugaggccgaguugaagugcuuugggaacacagcaguugcgaaaugcaaugagaaacaugaugaagaguuuugugacaugcuaagauuguuugacuuuaauaaacaagcuauaaggagacugaaagcagaagcacagaugaguauucaacuaauaaacaaagcagugaaugcacugaucaaugaccagcugauaaugaagaaucauuuaagagauaucauggggauuccuuacugcaauuacagcaaguauugguaucugaaucacacuguaacaggaaggacaucguuaccaagaugcuggcuugugucaaaugguuccuaccugaaugagacacauuuuucugacgacauugaacaacaagcagacaacaugauaacagaacuguugcagaaggaguacauagacaggcaagggaaaacaccuuuaggguuaguggaucuuuuugucuucagcaccagcuuuuaucucaucagcaucuuccuccaccugguuaaaaucccaacccacagacauaucauagggaaacccugcccuaaaccacacagacucaaccacaugggcauaugcucauguggucuguacaaacauccuggugugccaguuaaguggaaaagauag

SEQ ID NO: 520 - RNA, 1473 nt, Artificial Sequence
  derived and/or modified CDS sequence (wt) from Lassa virus__AIT17674__GPC
augggacaaaucauaacauuuuuccaggaaguaccucaugucauagaggaagugaugaacauuguucugauugcucucagccuucuggcaauauugaaagggaucuacaauguugcuaccuguggccucuuuggauugguguccuuucuucucuuauguggaagaucaugcucaacaacuuacaaggguguuuaugagcuacaaacucuagagcuagacaugacaaaccucaauaugacaaugccuuuauccugcacgaaaaacaacagccaccauuacaucauggucggaaaugagacuggucuggagcugacuuuaacaaauacaagcaucaucaaccacaaguuuuguaaccuuucugaugcacauaaaaagaaucuuuauaaccaugcuuuaaugaguauuauuucaacuuuccacuuauccauuccuaacuuuaaucaguaugaagcaaugaguugugacuucaaugggggcaagauaaguguccaguacaaccuuagccauaguuaugcuguggaugcagcuaaccacugugggaccauugccaauggcgugcuucagacuuuuaugaggauggcuugggguggcaguuacauagcacuugauuccggaaaggggaauugggauuguauaaugaccuccuaccaauauuugauaauccaaaacaccacuugggaagaucacugucaguuuucucgcccauccccuauugguuaucugggguuacugucacaaaggaccagggacauuuacaucagucgaagacuucuugggacuuuuacuuggacucucucugauucugaagguaaugaaacaccagguggguauugucuaacaagauggaugcugauugaggccgaguugaagugcuuugggaacacagcaguugcgaaauguaaugagaaacaugaugaggaguuuugugacauguuaagauuguuugacuuuaacaaacaagcuauaaggaggcugaagacagaggcacaggcgaauauccaacugauaaauaaagcagugaacgcacugaucaaugaccagcugaucaugaagaaucauuugagagauaucaugggaauuccuuacugcaauuacagcaaguauugguacuuaaaucacacuguaacagggaagacaucguugccaagaugcuggcuugugucaaauggcuccuacuugaaugagacacauuuuucugaugacauugaacaacaagcagacaauaugauaacagaacuguugcagaaggaguacauggacaggcaagggaaaacacccuuaggguugguagaucuuuuugucuucagcaccagcuuuuaucucauuagcaucuuccuccaccugguuaaaaucccaacccacagacaugucauagggaaacccugcccuaaaccacacagacucaaccacaugggcauaugcucauguggucuguacaaacauccugguguaccagucaaguggaaaagauag

SEQ ID NO: 521 - RNA, 1473 nt, Artificial Sequence
  derived and/or modified CDS sequence (wt) from Lassa virus__AIT17678__GPC
augggacaaaucauaacauuuuuccaggaaguaccucaugucauagaggaaguuaugaacauuguccugaucacucucagccuucuggcaauacugaaagggaucuacaauauugcuaccuguggccucuuuggauugguguccuuucuccucuuauguggaagaucauguucaacaacuuacaagggugucuaugagcuacaaacuuuagagcuagauaugacaagccuuaauaugacaaugcccuugucuugcacgaagaacaauucccaccauuacaucauggucgggaaugagacuggccuggagcugacuuuaacaaauacaagcauuaucaaccacaaguuuugcaaccuuucugaugcacacaaaaagaaucuuuaugaucaugcuuuaaugaguaucauuucaaccuuccacuuauccauuccuaacuuuaaucaguaugaagcaaugaguugugauuucaauggggggaagauaaguguucaguacaaccuuagccacacuuaugcuguagaugcagcuaaccacugugggaccauugccaauggcguucuucagacuuuuaugaggauggcuugggguggcaguuauauagcacuugauuccggaaaggggagcugggauugcauaaugacuuccuaccaauauuugauaauccaaaacaccacuugggaagaucacugccaguuuucucgcccaucccccaucgguuaucuggggcugcugucacaaagaaccagggacauuuacaucagucgaagacuucuuggaacuuuuaccuggacucucucugacucugaaggcaaugaaacaccggguggguauugucuaacaagauggaugcugauugaggcugaguugaagugcuuugggaacacagcagucgcaaaaugcaaugagaaacaugaugaagaauuuugugacauguuaagauuguuugacuucaacaaacaagcuauaaggaggcugaagacagaagcacagaugaguauccagcugauaaacaaagcagugaacgcacugauuaaugaccagcugauuaugaagaaucacuugagagauauuaugggaauuccuuacugcaauuacagcaaguauugguaucuaaaucacacuguaacagggaagacaucgcuaccaagaugcuggcuugugucaaaugguuccuaccugaaugagacacauuucucugaugacauugaacaacaagcagacaacaugauaacagaacuguugcaaaaggaguacauagacaggcaagggaaaacacccuuaggguuaguagaccuuuuugucuucagcaccagcuuuuaucucauuagcaucuuccuccaccugguuaagaucccaacccacagacauaucauagggaaacccugccccaaaccacacagacucaaccauaugggcauauguucauguggucuguacaaacauccugguauaccagucaaguggaaaagauag

SEQ ID NO: 522 - RNA, 1473 nt, Artificial Sequence
  derived and/or modified CDS sequence (wt) from Lassa virus__AIT17686__GPC
augggacaaaucauaacauuuuuccaagaaguaccucaugucauagaggaagugaugaacauugucuuaauugcucucagccuucuggcaauacugaaagggauauacaauguugcuaccuguggccucuuuggauugguguccuuucuccucuuauguggaagaucaugcucaacaacuuacaaggguguuuaugagcuacaaacucuggagcuggacauggcgagccuuaauaugacaaugcccuuaucuugcacgaagaacaacagccaccauuacaucauggucggaaaugagaccggcuuggaguuaacuuuaacaaauacaaguauuaucaaccacaaguuuugcaaccuuucugaugcacauaaaaagaaucuuuaugaccaugcuuuaaugaguaucaucucaacuuuucacuuauccauuccuaacuuuaaucaguaugaagcaaugaguugugacuucaaugggggaaagauaaguguucaauacaaccuuagccacacuuaugcuguagaugcagcuaaccacugugggaccauugcuaauggcguucuucagacuuuuaugaggauggcuugggguggcaguuacauagcacuugauuccagaaaggggaguugggauugcauaaugacuuccuaccaauauuugauaauccaaaacaccacuugggaagaucacugccaguuuucucgcccaucccccaucgguuaucuggggcuacugucacaaaggaccagggacauuuauaucagucgaagacuucuugggacuuuuacuuggacucucucugauucugaagguaaugaaacaccggguggguauugucuaacaagauggaugcugauugaggccgaguugaagugcuuuggaaacacagcaguugcgaaaugcaaugagaaacaugaugaagaguuuugugacauguuaagauuguuugacuuuaacaaacaagcuauaaggaggcugaagacagaagcacagaugaguauccaacugauaaacaaagcagugaacgcacugaucaaugaccagcugauuaugaagaaucauuugagagauaucaugggaauuccuuacugcaauuacagcaaguauugguaucuaaaucacacugugacagggaagacaucguugccaagaugcuggcuugugucaaaugguuccuaccugaaugagacacacuuuucugaugauauugagcaacaagcagacaacaugauaacagagcuguuacaaaaggaguacauggacaggcaagggaaaacacccuuaggguuaguagaucuuuuuguuuuuagcaccagcuuuuaucucauuagcaucuuccuccaccugauuaaaaucccaacccacagacaugucauagggaaaccuugcccuaaaccacacagacucaaccacaugggcauaugcucauguggucuguacaaacauccugguguaccagucaaguggaaaagauaa

SEQ ID NO: 523 - RNA, 1473 nt, Artificial Sequence
  derived and/or modified CDS sequence (wt) from Lassa virus__AIT17690__GPC
auggggcaaaucauaacauucuuccaggaaguaccucaugucauagaagaagugaugaacauuguccugauugcccucagccuucuggcaauauugaaaggaaucuacaauguugcuaccuguggccucuuuggauugguguccuuucuucucuuauguggaagaucaugcucaacaacuuacaaagguguuuaugagcugcaaacucuagagcuagacauggcaagccuuaauaugacaaugcccuuaucuugcacaaagaauaacagccaccauuacaucauggucgggaaugagacuggccuagagcugaccuuaacaaauacaaguaucauuaaccacaaguuuuguaaccuuucugaugcacauaaaaagaaucuuuaugaccaugcuuuaaugaguaucaucucaacuuuccacuuauccaucccuaauuuuaaucaguaugaagcaaugaguugugacuucaauggagggaagauaaguguucaguacaaccuuagccacgcuuaugcuguagaugcagccagccacugugggaccguugccaauggcguucuucagacuuucaugaggauggcuugggguggcaguuacauagcacuugauuccgggaaagggaguugggauuguauaaugacuuccuaccaauauuugauaauccagaacaccaccugggaagaccacugccaguuuucucgcccaucccccaucgguuaucuggggcuacugucacaaaggaccagggacauuuacaucagucgaagacuccuugggacuuuuacuuggacccucucugauucugaaggcaaugaaacaccggguggauauugucuaacaagauggaugcugauugaggccgaauugaagugcuuugggaacacagcaguugcgaagugcaaugagaaacaugaugaagaguuuugugacauguuaagauuguuugacuuuaacaaacaagcuauaaggaggcugaagacagaagcacagaugaguauccaacugauaaacaaagcagugaacgcacugaucaacgaccagcugauuaugaagaaucauuuaagagauaucaugggaauuccuuacugcaauuacagcaaauauugguauuuaaaucacacuguaacagggaggacaucguugcccagaugcuggcuugugucaaaugguuccuaccugaaugagacacauuuuucugaugauauugaacaacaagcagacaacaugauaacagaacuguugcagaaggaguacauggacaggcaagggaaaacacccuuaggguuaguagaucuuuuugucuuuagcaccagcuuuuaucucauuagcaucuuccuccaccugguuaaaaucccaacucacagacaugucauagggaaacccugcccuaaaccacacagacucaaccacaugggcauaugcucauguggucuguacaaacauccugguguaccagucaaauggaaaagauag

SEQ ID NO: 524 - RNA, 1473 nt, Artificial Sequence
  derived and/or modified CDS sequence (wt) from Lassa virus__AIT17694__GPC
augggacaaaucauaacauuuuuccaggaaguaccucaugucauagaggaagugaugaacauuguccugauugcucucagccuucuggcaauacugaaggggaucuacaauguugcuaccuguggccucuuuggacugguguccuuccuccucuuauguggaagaucauguucaacaauuuacaaggguguuuaugagcuacaaacucuggagcuagacauggcaagccuuaauaugacaaugcccuuaucuugcacgaagaacaacagccaccauuacaucauggucggaaaugagacuggcuuggagcugacuuuaacaaauacaaguaucaucaaccacaaauuuuguaaccucucugaugcacauaaaaagaaucuuuaugaucaugcuuuaaugaguaucauuucaaccuuccacuuauccauuccuaacuuuaaucaguaugaagcaaugagcugugacuucaauggggggaagauaaguguucaguacaaccucagccacacuuaugcuguggaugcagccaaccacugugggacuaucgccaaugguguucuucagacuuuuaugaggauggcuugggguggcaguuauauagcacuugauuccggaaaggggagcugggacuguauaaugacuuccuaucaauauuugauaauccaaaacaccacuugggaagaucacugccaguuuucucguccauccccuaucgguuaccuagggcuacugucacaaaggaccagggacauuuacaucagucgaagacuucuugggacuuuuacuuggacucucucugauucugaagguaaugaaacaccggguggguauuguuuaacaagauggaugcugauugaggccgaguugaaaugcuuugggaacacagcaguugcgaaaugcaaugagaaacaugaugaagaguuuugugacauguuaagauuauuugacuuuaacaaacaagcuauaagaaggcuaaagacagaagcacagaugaguauccagcugauaaacaaagcagugaacgcacugaucaaugaccagcugauuaugaagaaucauuugagagacaucauggggaucccuuacugcaauuacagcaaguacugguaucuaaaucauacuguaacagggaagacaucguugccaaggugcuggcuugugucaaaugguuccuaccugaaugagacacauuuuucugaugacauugaacaacaagcagacaacaugauaacagaacuacugcaaaaggaguacauagacaggcaagggaaaacaccuuuaggguuaguagaucuuuuugucuucaguaccagcuuuuaucucauuagcaucuuccuccaccugguuaaaaucccaacccacagacaugucguaggaaaacccugcccuaaaccacacagacucaaccacaugggcauauguucauguggucuauauaaacauccuggugugccagucaaguggaaaagauag

SEQ ID NO: 525 - RNA, 1473 nt, Artificial Sequence
  derived and/or modified CDS sequence (wt) from Lassa virus__AIT17712__GPC
augggacaaaucauaacauuuuuccaggaaguaccucaugucauagaggaagugaugaacauuguccugauugcucucagccuucuggcaauacugaaagggaucuacaauguugcuaccuguggucucuuuggauugguguccuuucuccuuuuauguggaagaucauguucaacaaccuacaaggguguuuaugaacuacaaacucuagagcuggacauggcaagccuuaauaugacaaugccccuaucuugcacgaagaacaacagccaccauuacaucauggucgggaaugagacuggcuuagagcugacuuuaacaaauacaaguauuaucaaccacaaguuuuguaaucuuucugaugcacauaaaaagaaucuuuaugaccaugcuuuaaugaguaucauuucaaccuuccacuuguccaucccuaacuuuaaucaguaugaagcgaugaguugugacuucaaugggggaaagauaaguguucaguacaaccuuagccacacuuaugcuguagaugcagccaaccacugcgggaccaucgccaauggcguucuucagacuuuuaugaggauggcuugggguggcagcuacauagcacuugauuccggaaaaggggcuugggauuguauaaugacuuccuaccaauauuugauaauccagaacaccacuugggaagaucauugccaguuuucucgcccauccccuaucgguuaucuggggcuacugucacaaaggaccagggacauuuacaucagucgaagacuucuugggacuuuuacuuggacucucuccgauucugaagguaaugaaacaccggguggguacugucuaacaagauggaugcugauugaggccgaguugaagugcuuugggaacacagcaguugcgaaguguaaugagaaacaugaugaagaguuuugugacauguuaagauuguuugacuuuaacaaacaagcuauaaugaggcugaagacagaagcacagaugaguauccaacugauaaacaaagcagugaacgcacuaaucaaugaccagcugauuaugaaaaaucacuugagagacaucaugggaauuccuuacugcaauuacagcaaguacugguaucuaaaucacacuguuacagggaagacaucguugccaaggugcuggcuugugucaaaugguucuuaccuaaaugaaacacauuuuucugaugacauugaacaacaagcagauaacaugauaacagaaauguugcaaaaggaguacauagacaggcaagggaaaacacccuuaggguuaguagaucuuuuugucuuuagcaccagcuuuuaucucauuagcaucuuccuccaccuggucaaaaucccaacccacagacaugucauagggaaacccugccccaaaccgcacagacucaaccacaugggcauaugcucauguggucuauacaaacauccugguguaccagucagguggaaaagauag

SEQ ID NO: 526 - RNA, 1473 nt, Artificial Sequence
  derived and/or modified CDS sequence (wt) from Lassa virus__AIT17718__GPC
augggacaaauuauaacauuuuuccaggaaguaccucaugucauagaggaagugaugaacauugucuugauugcucucagccuucuggcaauacugaaagggaucuacaauguugccaccugcggccucuuuggauugguguccuuucuacucuuauguggaagaucaugcucaacaacuuacaaggguguuuaugaacuacaaacucuagagcuagacauggcaagccucaacaugacaaugcccuuaucuugcacgaagaacaacagccaccauuacaucagggucggaaaugagacuggcuuggagcugacuuuaacaaaugcaaguaucaucaaccacaaguuuuguaaucuuucugaugcacauaaaaagaaccuuuaugaccaugcuuuaaugagcaucaucucgacuuuccacuuguccauucccaacuuuaaucaguaugaagcaaugaguugugacuucaauggagggaagauaaguguucaauacaaccuuagccacgcuuaugcuauagaugcagcuaaccacugugggacuguugccaauggcguucuucagacuuucaugaggauggcuugggguggcaguuauauagcacuugauuccggaagagggaauugggauuguauaaugacuucuuaccaauauuuaauaauccaaaacaccacuugggaagaucacugccaguuuucucguccauccccuauuggcuaucuagggcuacugucacaaagaaccagggacauuuauaucagucgaagacuucuugggacuuuuaccuggacucucucugacuccgaggguaaugaaacaccaggugguuauugucuaacaagauggaugcugauugaagccgaguugaagugcuuuggaaacacggcaguugcgaaauguaaugagaaacaugaugaggaguuuugugacauguuaagauuguuugacuucaacaaacaagcuauaaggaggcugaagacagaagcacagaugaguauccaacugauaaacaaagcagugaacgcacugaucaaugaccagcuaauuaugaagaaucacuuaagagauaucauggggauuccuuacugcaauuacagcaaguauugguauuuaaaucacacuguaacagggaagacaucguugccuagaugcuggcuugugucaaaugguuccuacuugaaugagacacauuuuucugacgacauugaacaacaagcagacaacaugauaacagaacuguugcagaaggaguacauggauaggcaagggaaaacacccuuaggguuaguggaucucuuugucuucagcacuaguuucuaccucauaagcaucuuccuccaccuggucaaaaucccaacccacagacaugucauagggaaaccuugccccaagccucacagacucaaccacaugggcauaugcuccugugguuuuuacaaacauccugguguaccagucaaguggaagagauag

SEQ ID NO: 527 - RNA, 1473 nt, Artificial Sequence
  derived and/or modified CDS sequence (wt) from Lassa virus__AIT17724__GPC
augggacaaaucauaacauuuuuccaggaaguaccucauguaauagaggaagugaugaacauuguccugauugcucucagccuucuggcaauacugaaagggaucuacaauguugcuaccuguggccucuuuggacugguguccuuccuccucuuauguggaagaucaugcucaacaacuuacaaggguguuuaugagcuacaaacucuagaguuagacauggcaaaccuuaauaugacaaugcccuuaucuugcacgaagaacaacagccaccauuacaucaugguuggaaaugagacuggcuuggagcugacuuuaacaaauacaagcauuaucaaccauaaguuuugcaaccuuucugaugcacacaaaaagaaucuuuaugaccaugcuuugaugaguaucaucucaaccuuccacuuauccauuccuaacuuuaaucaauaugaagcgaugagcugugacuucaauggggggaagauaaguguucaguacaaccuuagccacacuuaugcuguagaugcagccaaccacugugggaccgucgccaauggcguucuucagacuuucaugaggauggcuugggguggcaguuacauagcacuugauuccggaaaagggaguugggauuguauaaugacuuccuaccaauauuugauaauccaaaacaccacuugggaagaucacugccaguuuucucgcccaucccccaucgguuaucuggggcuacugucacaaaggaccagggacauuuacaucagccgacgacuccuugggacuuuuacuuggacucucucugauucugaagguaaugaaacaccggguggguauugucugacaagauggaugcugauugaggccgaguuaaagugcuuugggaacacagcaguugcgaaaugcaaugagaaacaugaugaagaauuuugugacauguuaagauuauuugacuuuaacaaacaagcuauaaggaggcugaagacagaagcacagaugaguauccaacugauaaacaaagcagugaacgcacugaucaaugaccagcugauuaugaagaaucauuugagagauaucaugggaauuccuuacugcaauuacagcaaguacugguaucuaaaucauacuguaacagggaagacaucguugccaaggugcuggcuugugucaaaugguuccuaucuaaaugagacacauuuuucugaugacaucgaacaacaagcagacaacaugauaacagaacuguugcaaaaggaguacauggacaggcaagggaaaacacccuuaggguugguggaucuuuuuguuuuuagcaccagcuuuuaucucauuagcaucuuccuccaccugguuaaaaucccaacccacagacauaucauggggaaacccugcccuaaaccacacagacucaaccacaugggcauaugcucauguggucuauauaaacaccccgguguaccagucaaguggaaaagauag

SEQ ID NO: 528 - RNA, 1473 nt, Artificial Sequence
  derived and/or modified CDS sequence (wt) from Lassa virus__AIT17728__GPC
augggacaaaucauaacauuuuuccaagaaguaccucaugucauagaggaagugaugaacauuguccugauugcucucagucuuuuggcaauauugaaagggaucuacaauguugcuaccuguggccucuuuggauugguguccuuucuccucuuauguggaagaucaugcucaacaacuuacaaggguguuuaugagcuacaaacucuagagcuagacauggggagccuuaauaugacaaugcccuuaucuugcacgaagaacaacucccaccauuacaucauggucggaaaugagacuggcuuggagcugacuuuaacaaauacaaguauuaucaaccacaaguuuugcaaccuuucugaugcacauaaaaagaaucuuuaugaccaugcuuuaaugaguaucaucucaaccuuccacuuguccauuccaaacuuuaaucaguaugaagcaaugaguugugauuucaauggggggaagauaaguguucaguacaaccuuagccacacuuaugcuguagaugcagcuaaccacugugggaccauugcuaauggcguucuucaaacuuuuaugaggauggcuugggguggcaguuacauagcacuugacuccggaaaggggagcugggacugcauaaugacuuccuaccaauauuuaauaauccaaaacaccacuugggaagaucacugccaguuuucucguccaucccccaucgguuaccuggggcuacugucacaaaggaccagggacauuuacaucagucgaagacuucuugggacuuuuacuuggacccucucugauucugaagguaaugaaacaccagguggguauugucuaacaagauggaugcugauugaggccgaguugaagugcuuugggaacacagcgguugcgaagugcaaugaaaaacaugaugaagaguuuugugacauguuaagauuguuugauuuuaacaaacaagcuauaaggaggcugaagacagaagcacagaugaguauucaacugauaaacaaagcagugaacgcacugaucaaugaccagcugauuaugaagaaucauuuaagagauaucaugggaauuccuuacugcaauuacagcaaguauugguaucuaaaucacacuguaacagggaagacaucguugccaagaugcuggcuugugucaaaugguuccuaccuaaaugagacacauuuuucugaugacauugaacaacaggcagacaacaugauaacagaacuguugcaaaaagaguacauggacaggcaagggaagacacccuugggguuaguagaucucuuugucuucagcaccagcuuuuaucucauuagcaucuuccuccaccugguuaaaaucccaacucacagacaugucauagggaaacccugucccaaaccacauagacucaaccacaugggcauaugcucauguggucuguacaaacauccuggugugccagucaaguggaaaagauag

SEQ ID NO: 529 - RNA, 1473 nt, Artificial Sequence
  derived and/or modified CDS sequence (wt) from Lassa virus__AIT17732__GPC
augggacaaauuauaacauucuuucaagaaguaccucaugucauagaggaagugaugaacauuguccugauugcucucagccuucuggcaauacugaaagggaucuacaauguugccaccuguggccucuuuggauugguguccuuucuccucuuauguggaagaucaugcucaacaacuuacaagggugucuaugagcuacaaacucuagagcuagauauggcaagccuuaauaugacaaugccccuaucuugcacaaagaacaacagccaccauuacaucauggucggaaaugagacugguuuggagcugacuuuaacaaauacaagcauuaucaaccacaaguuuuguaaccuuucugaugcacacaaaaagaaucucuaugaccaugcuuuaaugaguaucaucucaaccuuccacuuauccauuccuaauuucaaucaguaugaagcaaugaguugugacuucaauggggggaagauaaguguacaguauaaccuuagucacacuuaugcuguugaugcagccaaucacugugggacuauugccaacgguguccuucagacuuuuaugagaauggcuugggguggcaguuacauagcacuugauuccggaaaggggaguugggauuguauaaugacuuccuaccaauauuugauaauccaaaauacuacuugggaagaucauugccaguuuucucgcccauccccuaucgguuaucuggggcuacugucacaaaggaccagggacauuuacaucagucgaagacuucuugggacuuuuacuuggacucucucugauucugaagguaaugaaacaccggguggguauugucuaacaagauggaugcugauugaggcugaauugaagugcuuuggaaacacagcaguugcgaaaugcaaugagaaacaugaugaagaguuuugugacauguuaagacuguuugacuuuaacaaacaagcuauaaggagguugaagacagaagcacagaugaguauccaacugauaaacaaagcagugaacgcacugaucaaugaccagcuuauuaugaagaaucacuugagagauaucaugggaauuccuuacugcaauuacagcaaguacugguaucuaaaucacacuguaacagggaagacaucguugccaaggugcuggcuugugucaaaugguuccuaccugaaugagacacauuuuucugaugauauugaacaacaagcagacaacaugauaacagaacuauugcaaaaggaguauauagacaggcaagggaaaacacccuugggguuaguagaucuuuuugucuuuagcaccagcuuuuaucucauuagcaucuuccuccaccuagucaaaaucccaacccacagacauaucguugggaagcccugcccuaaaccacacagacucaaccacaugggcauaugcucauguggucuauacaagcauccugguguaccaguuaaguggaagagauag

SEQ ID NO: 530 - RNA, 1473 nt, Artificial Sequence
  derived and/or modified CDS sequence (wt) from Lassa virus__AIT17736__GPC
augggacaaaucgugacauuuuuccaggaaguaccucaugucauagaggaagugaugaacauuguccugauugcucucagccuucuggcaauacugaaagggaucuacaauguugcuaccuguggccucuuuggauugguguccuuucuccuuuuauguggaagaucauguucaacaaccuacaaagguguuuaugagcuacaaacucuagagcuggacauggcaagccuuaauaugacaaugcccuugucuugcacgaagaacaacagccaccauuacaucauggucggaaaugagacuggcuuagagcugaccuuaacaaauacaaguauuaucaaccacaaguuuugcaaccuuucugaugcacacaaaaaggaucuuuaugaccaugcuuuaaugaguaucauuucaaccuuccauuuauccauuccuaacuuuaaucaguaugaagcgaugaguugugacuucaauggggggaagauaaguguucaguacaaccuuagccacacuuaugcuguagaugcagccaaccacugugggacuaucgccaauggcguucuucagacuuuuaugaggauggcuugggguggcagcuacauagcacuugauuccggaaaagggaguugggauuguauaaugacuuccuaccaauauuugauaauccaaaacaccacuugggaagaucauugccaguuuucucgcccauccccuaucgguuaucuggggcuacuaucacaaagaaccagggacauuuacaucagucgaagacuucuugggacuuucacuuggacucucucugauucugaagguaaugaaacaccggguggguauugucuaacaagauggaugcugauugaggccgaguugaagugcuuugggaacacagcaguugcgaagugcaaugagaaacaugaugaagaguuuugugacauguuaagauuguuugacuuuaacaaacaagcuauaaugaggcugaagacagaagcacagaugaguauccaauugauaaacaaagcagugaacgcacugaucaaugaccagcugauuaugaagaaucauuugagagacaucaugggaauuccuuacugcaauuacagcaaguacugguaucuaaaucacacuguuacagggaagacaucguugccgaggugcuggcuuguaucaaaugguucuuaccugaaugagacacguuuuucugaugacauugaacaacaagcagacaacaugauaacagaaauguugcaaaaggaguacuuagacaggcaagggaaaacacccuuaggguuaguagaucuuuuugucuuuagcaccagcuuuuaucucauuagcaucuuccuccaccuggucaaaaucccaacccacagacacaucauagggaaacccugccccaaaccgcacagacucaaccacaugggcauaugcucauguggucuauacaaacauccugguguaccagucaaguggaaaagauaa

SEQ ID NO: 531 - RNA, 1473 nt, Artificial Sequence
  derived and/or modified CDS sequence (wt) from Lassa virus__AIT17744__GPC
auggggcaaaucauaacauuuuuccaggaagugccucaugucauugaggaggugaugaacauugucuugauugcucucagccuucuagcaauacuaaaagggauuuacaauguugcuaccuguggccucuuuggguugauguccuuucuucucuuauguggaaggucaugcucaacaacuuacaaggguguuuaugagcuucaaacucuggagcuggauauggcaaaccuuaauaugacaaugcccuuauccugcacgaagaacaacagccaccacuacaucaugguuggaaaugagacuggcuuggagcugacuuuaacaaacacaaguaucaucaaccacaaguucugcaaccuuucugaugcacauaaaaagaaucucuaugaccaugcuuuaaugagcaucaucucaaccuuccaucuauccaucccuaacuuuaaucaguaugaagcaaugaguugugacuucaaugggggaaagauaaguguucaguacaaccucagccaugcuuaugcuguggaugcagcuaaccauugugggaccauugccaauggaguccuucaaacuuuuaugaggauggccugggguggcaguuacauagcacuugauucuggaaaagggaguugggauuguauuaugacguccuaccaauauuugauaauccaaaacaccaguugggaagaucacugccaguuuucucgcccguccccuaucgguuaucuggggcuacugucacaaagaaccagggacauuuacaucagccgaagacuccuuggaacuuuuaccuggacucucucugauucugagggcaaugaaacaccggguggguauuguuuaacaagauggaugcugauugaggccgaauuaaagugcuuugggaacacagcaguugcgaaaugcaaugagaaacaugaugaagaguuuugugacauguuaagguuguuugacuuuaacaaacaggcuauaaggaggcuaaagacagaagcacagaugaguauccaacuaauaaacaaagcagugaacgcacugaucaaugaccagcucauuaugaagaaucauuuaagagauaucaugggaauuccuuacugcaauuacagcaaguauugguauuuaaaccacacuguaacagggaagacaucguugccaagaugcuggcuuguaucaaaugguuccuaccugaaugaaacacauuuuucugaugacauugagcaacaagcagacaacaugauaacagaauuguuacagaaagaguacauugacaggcaagggaaaacacccuuaggguugguggaucuuuuugucuucagcacuaguuucuaccuuauuagcaucuuccuccaccuggucaaaaucccaacccacagacaugucauagggaaacccugccccaagccacacagacucaaccacaugggcauaugcucauguggucuguacaaacauccugguguaccagucaaguggaaaagauag

SEQ ID NO: 532 - RNA, 1473 nt, Artificial Sequence
  derived and/or modified CDS sequence (wt) from Lassa virus__AIT17752__GPC
augggacaaaucauaacauuuuuccaugaaguaccucaugucauagaggaaguaaugaacauuguucugauugcucucagccuucuggcaauacugaaagggaucuacaauguugcuaccuguggccucuuuggauugguauccuuucuccucuuauguggaagaucaugcucaacaacuuacaaggguguuuaugagcugcagacucuagagcuagacauggcaagccuuaauaugacaaugcccuuaucuugcacgaagaauaacucccaccauuacaucaugguuggaaaugagacuggcuuggagcugaccuuaacaaauacaagcauuaucaaccacaaguuuuguaaccuuucugaugcacauaaaaagaaucuuuaugaccaugcuuuaaugaguaucaucucaaccuuccacuuaucaauuccuaacuuuaaucaguaugaagcaaugaguugugacuucaaugggggaaagauaaguguucaguacaaucuuagccacacuuaugcuauagaugcagccaaccauugugggaccauugcuaauggcguucuucagacuuuuaugaggauggcuugggguggcaguuacauagcacuugauucuggaaggggaagcugggauugcauaaugacuuccuaccaauauuugauaauccaaaacaccacuugggaagaucacugccaguuuucucgcccauccccuaucgguuaucuggggcugcugucacaaaggaccagggacauuuacaucagucgaagacuucuugggaccuucacuuggacucucucugacuccgaagguaaugaaacaccggguggguauugucuaacaagauggaugcuaauugaggccgaguugaagugcuuugggaacacagcaguugcaaaaugcaaugagaaacaugaugaagaguuuugugacauguuaagauuguuugacuuuaacaaacaagcuauaaggaggcugaagacagaagcacagaugaguauccaacugauaaacaaagcaguaaacgcacugaucaaugaccagcugauuaugaagaaucauuugagagauaucaugggaauuccuuacugcaauuacagcaaauauugguaucuaaaucacacuguaacagggaagacaucguugccaagaugcuggcuugugucaaaugguuccuaucugaaugagacgcauuuuucugaugacauugaacaacaagcagacaacaugauaacagagcuauugcaaaaggaguacauagacaggcaaggaaaaacacccuuaggcuuaguagaucuuuuugucuucagcaccagcuuuuaucucauuagcaucuuucuccaccuggucaaaaucccaacccacagacaugucauagggaagcccugccccaaaccacacagacucaaccacaugggcauaugcucauguggucuguacaagcacccuggcgugccagucaaguggaaaagauag

SEQ ID NO: 533 - RNA, 1473 nt, Artificial Sequence
  derived and/or modified CDS sequence (wt) from Lassa virus__AIT17756__GPC
auggggcaaaucauaacauuuuuucaggaagugccucaugucauagaagaagugaugaacauuguccugauugcccuuagccuucuggcaauauugaaagggaucuacaauguugcuacuuguggccucuuuggacugguguccuuucuucucuuauguggaagaucaugcuccauaacuuacaaagguguuuaugagcuacaaacucuagagcuagacauggcaagccuuaauaugacaaugcccuuaucuuguacaaagaauaauagccaccauuacaucauggucggaaaugaaacuggcuuagagcugacuuuaacaaauacaaguaucaucaaccacaaguuuuguaaccuuucugaugcacauaaaaagaaucuuuaugaccaugcuuuaaugagcaucaucucaaccuuccacuuauccauuccuaacuuuaaucaauaugaggcaaugagcugugacuucaauggggggaagauaaguguucaguacaaccuuagccacacuuaugcuguagaugcagcuaaccacugugggacuauugccaauggcguucuucagacuuucaugaggauggcuugggguggcagcuacauagcacuugauuccggaagagggaguugggauuguauaaugacuuccuaccaauauuugauaauccagaacaccacuugggaagaucacugccaguuuucucgcccaucccccaucgguuaucugggacuacugucacaaaggaccagggacauuuacaucagucgaagacuccuugggacuuuuacuuggacccucucugauucugaaggcaaugaaacuccagguggguauugucugacaagguggauguugauugaggccgaguugaagugcuuugggaacacagcaguugcgaaaugcaaugaaaaacaugaugaagaguuuugugacaugcuaagauuguuugacuuuaacaaacaagcuauaaggaggcugaaagcagaagcacagaugaguauccaacuaauaaacaaagcagugaaugcacugauuaaugaccagcugauaaugaagaaucauuuaagagauaucaugggaauuccuuacugcaauuacagcaaguauugguaucugaaucacacuguaacagggaggacaucguuaccaagaugcuggcuugugucaaaugguuccuaccugaaugagacacauuuuucugaugacauugaacaacaagcagacaacaugauaacagaacuguugcagaaggaauacauagauaggcaagggaaaacaccuuuaggguuaguagaucuuuuugucuucagcaccagcuuuuaucucaucagcaucuuccuccaccugguuaaaaucccaacccacagacauaucauagggaaacccugcccuaaaccacauagacucaaccacaugggcauaugcucauguggucuguacaagcauccuggugugccagucaaguggaaaagauag

SEQ ID NO: 534 - RNA, 1473 nt, Artificial Sequence
  derived and/or modified CDS sequence (wt) from Lassa virus__AIT17758__GPC
augggacaaaucauaacauuuuuccaggaaguaccucaugucauagaggaagugaugaacauuguccugauugcucucagccuucuggcaauacugaaagggaucuacaauguugcuaccuguggccucuuuggauugguguccuuucuccucuuauguggaagaucaugcucaacaacuuacaaggguguuuaugagcuacaaacucuagagcuaaacauggcaagccuuaauaugacgaugcccuuaucuugcacaaagaacaacagccaccauuacaucauggucggaaaugagacuggcuuggagcuaacuuuaacaaauacaaguauuauaaaccacaaguuuuguaaccuuucugaugcacauaaaaggaaucuuuaugaccaugcuuuaaugaguaucaucucaaccuuccacuuaucuauucccaauuuuaaucaguaugaagcaaugagcugugacuucaaugggggaaagauaaguguucaguacaaccuuagccacacuuaugcuguagaugcagccaagcacugugggacuaucgccaauggcguucuucagacuuuuaugaggauggcuugggguggcaguuacauagcacuugauuccggaaaggggaguugggauuguauaaugacuuccuaucaauauuugauaauccagaacaccaccugggaagaucacugcgaguuuucucgcccauccccuaucgguuaucuggggcuacugucacaaaggaccagggacauuuacaucagucgaagacuucuugggacuuuuacuuggacucucucugacucugaagguaaugaaacgccggguggguauugucuaacaagauggaugcugauugaggcugaauugaagugcuuugggaacacagcaguugcgaaaugcaaugagaaacaugaugaagaguuuugugacauguugagacuguuugacuuuaacaaacaagcuauaaggaggcugaaggcagaagcacagaugaguauccaacugauaaacaaagcagugaacgcacugaucaaugaccagcuuauuaugaagaaucacuugagagauaucaugggaauuccuuacugcaauuacagcaaguacugguaucuaaaucacacuguaacagggaagacaucguugccaaggugcuggcuugugucaaaugguuccuaccugaaugagacacauuuuucugaugacauugaacaacaagcagacaacaugauaacagaacuguugcaaaaggaauacauagacaggcaagggaaaacacccuuaggguuaguagaucuuuuugucuucagcaccagcuuuuaucucauuagcaucuuccuccaccuggucaaaaucccaacccacagacaugucauagggaaacccugcccuaaaccacacagacucaaccauaugggcauaugcucaugcggucuauacaagcauccuggugugccaguuaaguggaaaagauag

SEQ ID NO: 535 - RNA, 1473 nt, Artificial Sequence
  derived and/or modified CDS sequence (wt) from Lassa virus__AIT17762__GPC
auggggcagaucauaacauucuuccaggaaguaccucaugucauagaggaagugaugaacauuguccugauugcccucagccuucuggcaauauugaaagggaucuacaauguugcuaccuguggccucuuuggacuaguguccuuucuucucuugugugggagaucaugcucaacaaccuacaaggguguuuaugagcuacaaacucuagagcuagacauggcaagccuuaauaugacaaugcccuuaucuugcacgaagaauaacagccaccauuacaucauggucggaaaugagacugguuuagagcugacuuuaacaaauacaaguaucaucagccacaaguuuuguaaccuuucugaugcacauaaaaagaaucuuuaugaccaugcuuuaaugaguaucaucucgacuuuccacuuauccauaccuaacuuuaaucaguaugaggcaaugaguugcgacuucaauggggggaagauaaguguucaauacaaccuuagccacacuuaugcuguagaugcagcuaaccauugugggacuauugccaaugguguucuucagacuuucaugaggauggccugggguggcaguuauauagcacuugacuccggaaaggggaguugggauuguauaaugacuuccuaccaguauuugauaauccagaacaccacuugggaagaccacugccaguuuucucgcccaucccccaucgguuaucuggggcuacugucacaaaggaccagggauauuuacaucagucggagacuccuugggacuuuuacuuggacucucucugauucugaaggcaaugaagcaccggguggguauugucugacaagauggaugcugauugaggccgaguugaagugcuucggaaacacagcaguugcgaaaugcaaugagaaacaugaugaagaauuuugugacauguuaagauuguuugacuuuaacaaacaagcuauaaggaggcugaagacagaagcacaaaugaguauccagcuaauaaacaaagcagugaacgcacugaucaaugaccaacugauuaugaagaaucacuugagagauaucaugggaauuccuuacugcaauuacagcagguauugguauuuaaaucauacuguaacagggaagacaucgcugccaagaugcuggcuugugucaaaugguuccuaccugaaugagacacauuuuucugacgacauugaacaacaggcagacaacaugauaacagaacuguugcagaaggaguacauggacaggcaaggaaaaacacccuugggguugguggaucuuuuugucuucagcaccagcuuuuaucucauuagcaucuuccuccaccugguuaaaaucccaacccacagacaugucauagggaaacccugcccuaaaccacacagacucaaccacaugggcauaugcucauguggucuguacaaacauccugguguaccagucaaguggaaaagauag

SEQ ID NO: 536 - RNA, 1473 nt, Artificial Sequence
  derived and/or modified CDS sequence (wt) from Lassa virus__AIT17770__GPC
augggacaaauuguaacauuuuuccaggaaguaccucaugucauagaggaagugaugaacauuguccugauugcucucagccuucuagcaauacugaaagggaucuacaauguugcuaccuguggccucuuuggauugguguccuuucuccuuuuauguggaagaucaugcucaacaacuuacaaggguguuuaugagcuacaagcuuuggagcuagacaugucaagccuuaauaugacaaugcccuugucuugcacgaagaacaacagccaccauuacaucauggucggaaaugagaccggcuuggagcugacuuuaacaaacacaaguauuauccaccacaaguuuuguaaccuuucugaugcacauaaaaaggaucuuuaugaccaugcuuuaaugaguaucaucucaaccuuccacuuauccauuccuaacuuuaaucaguaugaagcaaugaguugugacuucaauggggggaagauaaguguucaguacaaccuuagccacacuuaugcuguagaugcagccaaccacugugggaccauugccaauggcguucuucagacuuuuaugaggauggcuugggguggcaguuacauagcacuugauuccgggaagggagguugggauugcauaaugacuuccuaccaauuuuugauaauccaaaacaccaccugggaagaucacugccaguuuucucgcccaucccccauugguuaucuggggcugcugucacaaaggaccagggacauuuauaucagucgaagacuucuuggaacuuuuacuuggacucucuccgauucugaagguaaugaaacaccggguggguauugucugacaagauggaugcugauugaggccgaguugaagugcuuugggaacacagcaguugcgaaaugcaacgagaaacaugaugaagaguuuugugacauguuaagauuguuugacuuuaacaagcaagcuauaaagaggcugaaaacagaagcacagaugaguauccaucugauaaacaaagcagugaacgcacugaucaaugaccagcugauuaugaagaaucauuugagagauauuaugggaaucccuuacugcaauuacagcaaguauugguaucuaaaucacacuguuacagggaagacaucguugccaagaugcuggcuugugucaaaugguuccuaccugaaugagacacauuuuucugaugacauugaacaacaagcagacaacaugauaacagaacuguugcaaaaggaguacauagauaggcaagggaaaacacccuuaggguuaguagaucuuuuugucuucagcaccagcuuuuaucuuauuagcaucuuccuccaccuaguuaaaauuccaacccacagacauguuauagggaaacccugcccuaaaccacauagacucaaccacaugggcauaugcucauguggucuguacaaacauccugguguaccagucagguggaaaagauag

SEQ ID NO: 537 - RNA, 1473 nt, Artificial Sequence
  derived and/or modified CDS sequence (wt) from Lassa virus__AIT17778__GPC
augggacaaaucauaacauuuuuccaggaagugccucaugucauagaagaagugaugaacauuguccugauugcccucagccuucuggcaauauugaaagggaucuacaauguugcuaccuguggccucuuuggauugguguccuuccuucucuuauguggaagaucaugcucaacaacuuacaaagguguuuaugagcuacaaacucuagagcuagacauggcaaaccuuaauaugacaaugcccuuaucuugcacaaagaauaacagccaccauuacaucauggucggaaaugagacuggcuuagagcugacuuuaacaaauacaaguaucaucaaccacaaguucuguaaccuuucugaugcacauaaaaagaaucuuuaugaccaugcuuuaaugaguaucauuucaaccuuccacuuauccauuccuaacuuuaaucaguaugaagcaaugaguugugacuucaauggggggaagauaaguguucaguacaaccuuagccacacuuaugcuagagaugcagcuaaccacugugguacuauugcuaauggcguucuccagacuuucaugaggauggcuugggguggcaguuacauagcacuugauuccggaaaagggagcugggauugcauaaugacuuccuaccaauauuugauaauccagaacaccacuugggaagaucacugccaguuuucucgcccaucccccaucgguuaucuggggcugcugucacaaaggaccagggacauuuacaucagucgaagacuccuugggacuuuuacuuggacccucucugauucugaaggcaaugaaacaccggguggguauugucuaacaagauggaugcugauugaggccgaauugaagugcuuugggaacacagcaguugcgaaaugcaaugagaaacaugaugaggaguucugugacauguugagauuguuugacuuuaacaaacaagcuauaaggagacugaagacagaagcacagaugaauauccaacugauaaacaaagcagugaacgcacugaucaaugaccagcugauuaugaagaaucauuuaagagauaucaugggaauuccuuacugcaauuacagcaaguauugguauuuaaaucacacugugacagggaagacaucguugccaagaugcuggcuugugucaaaugguuccuaccugaaugaaacacauuuuucugaugacauugaacaacaagcagacaacaugauaacagaacuguugcagaaggaguacauggacaggcaagggaaaacacccuuaggguuaguagaucuuuuugucuucagcaccaguuucuaucucauuagcaucuuucuccaccuaguuaagaucccaacucacagacaugucauaggaaaacccugcccuaaaccacacagacuuaaccacaugggcauaugcucauguggucuguacaaacauccugguguaccagucaaauggaaaagauag

SEQ ID NO: 538 - RNA, 1473 nt, Artificial Sequence
  derived and/or modified CDS sequence (wt) from Lassa virus__AIT17782__GPC
augggacaaaucauaacauuuuuccaggaaguuccucaugucauagaggaagugaugaacauuguccugauugcucucagccuccuggcaauacuaaaagggaucuacaauguugcuaccuguggccucuuuggauugguguccuuccuccucuuauguggaagaucaugcucaacaacuuacaaggguguuuaugagcugcaaacucuagagcuagacauggcaagccuuaauaugacaaugccucuaucuugcacgaagaauaacagccaccauuacaucauggucggaaaugagacuggcuuggagcugacuuuaacaaacacaaguauuaucaaucacaaguuuuguaaccuuucugaugcacacaaaaagaaucuuuaugaccaugcuuuaaugagcaucaucucaaccuuccauuuaucuauucccaacuucaaucaguaugaagcaaugaguugugacuucaaugggggaaagauaaguguucaguacaaccuuagccacacuuaugcuguagaugcagccaaccacugugggacuaucgccaauggcguccuucagaccuuuaugaggauggcuugggguggcaguuacauagcacuugauuccggaaaggggaguugggacuguauaaugacuuccuaucaauaucugauaauccaaaacaccacuugggaagaucacugccaguuuucucgcccaucuccuaucgguuaucuggggcuacugucacaaaggaccagagacauuuacaucagucgaagacuucuugggacuuucacuuggacucucucugauucugaagguaaugaaacaccggguggguacugucuaacaagguggaugcugauugaggccgaguugaagugcuuugggaacacagcaguugcgaaaugcaaugagaaacaugaugaagaguuuugugacauguuaagauuguuugacuuuaacaaacaagcuauaaagaggcugaagacagaagcacagaugaguauucaacugauaaacaaagcagugaacgcacugaucaaugaccagcugauuaugaagaaucauuugagagacaucaugggaauuccuuacuguaauuacagcaaguauugguaucuaaaucacaccguaacagggaagacaucguugccaaggugcuggcuugugucaaaugguuccuaccugaaugagacacacuuuucugaugacauugaacaacaagcagauaacaugauaacagaacuauugcaaaaggaguacauagacaggcaagggaaaacacccuuaggguuaguagaccuuuuugucuuuagcaccagcuuuuaucucauuagcaucuuccuccaccuggucaaaaucccaacccauagacaugucguagggaaacccugcccuaaaccacacagacucaaccacaugggcauaugcucauguggucuauacaaacauccugguguaccagucaaauggaaaagauag

SEQ ID NO: 539 - RNA, 1473 nt, Artificial Sequence
  derived and/or modified CDS sequence (wt) from Lassa virus__AIT17786__GPC
augggacaaaucauaacauuuuuccaggaaguaccucaugucauagaagaagugaugaacauuguccugauugcccucagccuucuggcaauuuugaaagggaucuacaauguugcuaccuguggccucuuuggauugguguccuuucuucucuuauguggaagaucaugcucaacaacuuacaaagguguuuaugagcuacaaacucuagagcuagacauggcaagccuuaauaugacuaugcccuuaucuugcacaaagaauaacagccaccauuacaucauggucggaaaugagacuggcuuagagcugacuuuaacaaauacaaguaucaucaaccacaaguucuguaaccuuucugaugcacauaaaaagaaucuuuaugaccaugcuuuaaugaguaucaucucaaccuuccacuuauccauuccuaacuuuaaucaguaugaagcaaugaguugugacuucaauggggggaagauaaguguucaguacaaccuuagccacgcuuaugcuauagaugcagcugaccacugugggacuauugcuaauggcguucuucagacuuucaugaggauggcuugggguggcaguuacauagcacuugauuccggaaaagggagcugggauugcauaaugacuuccuaccaauauuugauaauccagaacaccacuugggaagaucacugccaguuuucucgcccaucccccaucgguuaucuggggcugcugucacaaaggaccagggacauuuacaucagucgaagacuccuugggacuuuuacuuggacccucucugauucugaaggcaaugaaacaccggguggguauugucuaacaagauggaugcugauugaagccgaauugaagugcuuugggaacacagcaguugcgaaaugcaaugagaaacaugaugaggaguuuugugacauguuaagauuguuugacuuuaacaaacaagcuauaaggaggcugaagacagaagcacagaugaguauccaacugauaaacaaagcagugaacgcacugaucaaugaccagcugauuaugaagaaucauuuaagagauaucaugggaauuccuuacugcaauuacagcaaguauugguauuuaaaucacacuguaacagggaagacaucguugccaagaugcuggcuugugucaaaugguuccuaccugaaugagacacauuuuucugaugacauugaacaacaagcagacaacaugauaacagaacuguugcagaaggaguacauggacaggcaagggaaaacacccuuaggguuaguagaucuuuuugucuucagcaccaguuuuuaucucauuagcaucuuucuccaccuaguuaaaaucccaacucacagacauaucacaggaaaacccugcccuaaaccacacagacucaaccacaugggcauaugcucauguggucuguacaaacauccugguguaccagucaaauggaaaagauag

SEQ ID NO: 540 - RNA, 1473 nt, Artificial Sequence
  derived and/or modified CDS sequence (wt) from Lassa virus__AIT17790__GPC
augggacaaaucauaacauuuuuccaggaaguaccucauguuauagaggaagugaugaacauuguccugauugcucucagccuucuggcaauacugaaagggauuuacaauguugcuacuuguggccucuuuggauugguguccuuucuccucuuauguggaagaucaugcucaacaacuuacaaggguguuuaugagcuacaaacucuagaguuagacauggcaagccucaauaugacaaugcccuuaucuugcacgaagaacaacagccaccacuacaucauggucggaaaugagacuggcuuggagcugacuuuaacaaauacaaguauuaucaaccacaaguuuuguaaccuuucugaugcacauaaaaagaaucuuuaugaccaugcuuuaaugagcaucaucucaaccuuccacuuauccauuccuaacuucaaucaguaugaagcaaugaguugugacuuuaauggagggaagauaaguguucaguacaaccuuagccacacuuaugcuguagaugcagccaaccacugugggacuaucgccaauggcguucuucagaccuucaugaggauggccugggguggcaguuacauagcacuugauuccggaaaggggaguugggacuguauaaugacuuccuaccaauauuuaauaauccaaaacaccacuugggaagaucacugccaguuuucccgcccaucuccuauugguuaucuggggcuacugucacaaaggaccagggacauuuacaucagucggagacuucuugggacuuuuacuuggacucucucugauucugaaggcaaugaaacaccagguggguauugucugacaagauggaugcugauugaggccgaguugaagugcuuugggaacacggcaguugcgaaaugcaaugagaaacaugaugaagaguuuugugacauguuaagauuguuugacuuuaacaaacaagcuauaaggaggcugaagacagaagcacagaugaguauccaacuaauaaacaaagcagugaacgcacugaucaaugaccagcugauuaugaagaaucauuugagagauaucaugggaauuccuuacugcaauuacagcaaguacugguaucuaaaucacacuguaacagggaagacaucguugccgaggugcuggcuugugucaaaugguuccuaccugaaugagacacauuuuucugaugacauugaacaacaagcagacaacaugauaacagaacuguugcaaaaggaguauauggacaggcaagggaaaacacccuuaggguuaguagaucuuuuugucuucagcaccagcuuuuaucucauuagcaucuuccuccaccuggucaagaucccaacccacagacauaucacagggaaacccugcccuaaaccacacagacucaaccacaugggcauaugcucauguggucuauacaaacauccugguguaccaguuaaguggaaaagauag

SEQ ID NO: 541 - RNA, 1473 nt, Artificial Sequence
  derived and/or modified CDS sequence (wt) from Lassa virus__AIT17798__GPC
augggacaaaucauaacauuuuuccaggaaguaccucaugucauagaggaagugaugaacauuguccugauugcucucagccuucuggcaauacugaaagggaucuacaauguugcuaccuguggccucuuuggauugguguccuuucuccuuuuauguggaagaucauguucaacaaccuacaaagguguuuaugagcuacaaacucuagagcuggacauggcaagccuuaauaugacaaugcccuuaucuugcacgaagaacaacagccaccauuacaucauggucggaaaugagacuggcuuagagcugacuuuaacaaauacaagcauuaucaaccacaaguuuuguaaccuuucugaugcacauaaaaagaaucuuuaugaccaugcuuuaaugaguaucauuucaaccuuccacuuauccauuccuaacuuuaaucaguaugaagcgaugaguugugacuucaauggggggaagauaaguguucaguacaaccuuagccacacuuaugcuguagaugcagccaaccacugugggacuaucgccaauggcguucuucagacuuuuaugaggauggcuugggguggcagcuacauagcacuugauuccggaaaagggaguugggauuguauaaugacuuccuaccaauauuugauaauccaaaacaccacuugggaagaucauugccaguuuucucgcccauccccuaucgguuaccuggggcuacuaucacaaagaaccagggacauuuacaucagucgaagacuucuugggacuuucacuuggacucucucugauucugaagguaaugaaacaccggguggguauugucuaacaagauggaugcugauugaggccgaguugaagugcuuugggaacacagcaguugcgaagugcaaugagaaacaugaugaagaguuuugugacauguuaagauuguuugacuuuaacaaacaagcuauaaugaggcugaagacagaagcacagaugaguauccaauugauaaacaaagcagugaacgcacugaucaaugaccagcugauuaugaagaaucauuugagagacaucaugggaauuccuuacugcaauuacagcaaauacugguaucuaaaucacacuguuacagggaagacaucguugccgaggugcuggcuugugucaaaugguucuuaccugaaugagacacauuuuucugaugacauugaacaacaagcagacaacaugauaacagaaauguugcaaaaggaguacuuagacaggcaagggaaaacacccuuaggguuaguagaucuuuuugucuuuagcaccagcuuuuaucucauuagcaucuuccuccaccuggucaaaaucccaacccacagacacaucauagggaaacccugccccaaaccgcacagacucaaccacaugggcauaugcucauguggucuauacaaacauccugguguaccagucaaguggaaaagauaa

SEQ ID NO: 542 - RNA, 1476 nt, Artificial Sequence
  derived and/or modified CDS sequence (wt) from Lassa virus__AIT17802__GPC
augggacagauagugacauucuuccaggaagugccucauguaauagaagaggugaugaacauuguucucauugcacuguccauacuggcagugcugaagggucuguacaaucuugcaacauguggccucguugguuugguuacuuuccucuuguuguguggcaggucuugcacaaccagucuuuauaaagggguuuaugagcuucagacucuggaacuaaauauggagacacucaauaugaccaugccucucuccugcacaaagaacaacagucaucauuacauaaugguggguaaugagacaggacuggaacugaccuugaccaauacgagcauuauuaaucauaaauuuugcaaucugucugaugcccacaaaaagaaccucuauaaccaugcccuuaugagcauaauuucaacuuuccacuuguccauccccaacuucaaucaguaugaggcaaugagcugcgauuuuaaugggggaaagauuagugugcaguacaaccugagucacagcuaugcuggggaugcggcuaaccacuguggaacuguugcaaauggugucuuacagacuuucaugaggauggcuuggggugggaguuacauugcucuugacucaggccgugaccggugggacuguauuaugacuaguuaucaauaucugauaauccaaaauacaaccugggaagaucacugccaauucucaagaccaucacccaucgguuaucucgggcuccuuucacaaaggaccagagacauuuauauuagcaggagacuacuaggcacauuuacauggacacugucagauucugaaggcaaggacacaccagggggguauugucugaccagauggaugcugauugaagcugaauugaaaugcuucggaaacacagcuguagcaaaauguaaugagaagcaugaugaggaauuuugugacaugcugaggcuguuugacuucaacaagcaagccauucagaggcugaaagcugaagcacaaaugagcauucaguugaucaacaaagcaguaaaugcuuugauaaaugaccaacucauaaugaagaaccaucuacgggacaucaugggaauuccauacuguaauuacagcaaguauugguaccucaaccacacaacuacugggaaaacaucacugcccaaauguuggcuuguaucaaaugguucauacuugaacgagacccauuuuucugaugauauugaacaacaagcugacaacaugaucaccgaaauguugcagaaggaguauauggagagacugggaaagacaccauugggucuaguugaccucuuuguguucagcacaaguuucuaucucauaagcaucuuccuucaccuagucaaaauaccaacucauaggcauauuguaggcaggucaugucccaaaccucacagauugaaucauaugggcauauguuccuguggacucuauaaacagcccggugugccugugaaauggaagagauga

SEQ ID NO: 543 - RNA, 1476 nt, Artificial Sequence
  derived and/or modified CDS sequence (wt) from Lassa virus__AIT17806__GPC
augggacagauagugacauucuuccaggaagugccucauguaauagaagaggugaugaacauuguucucauugcgcugucuauauuagcagugcugaaaggucuauacaacuuugcaacauguggccucauuggccuggucacuuuucuccuguuguguggcagguccugcacaaccagucuuuauaaaggggucuaugagcuucagacucuggaguuaaacauggagacacucaauaugaccaugccucucuccugcacaaagaauaacagucaucauuauauaaugguaggcaaugagacaggacuagaacugaccuugaccaacacaaguauuauuaaucauaaauuuugcaaucugucugaugcucacaaaaagaaccucuaugaccacgcucuuaugagcauaauuucaacuuuccauuuguccauccccaacuucaaucaguaugaggcaaugagcugcgauuuuaaugggggaaagauuagugugcaguacaaccugagucacagcuaugcuggggaugcugccaaccauuguggcacuguugcaaauggugucuuacagacuuucaugagaauggcuuggggugggagcuacauugcucuugacucaggccguggcaagugggauuguaucaugacuaguuaucaauaucugauaauucaaaauacaaccugggaagaucacugccaauucucaagaccaucuccuaucgguuaucuugggcuccucucacaaaggaccagagacauuuauaucaguagaagacuacuaggcacauucacauggacacugucagauucugaaggcaaggacacaccagggggauauugucugaccagauggaugcugauugaagcugaauuaaaauguuucgggaacacagcuguggcaaaauguaaugagaagcaugaugaggaauuuugugacauguugaggcuguuugacuucaacaaacaggccauucaaagguugaaagcugaagcacaaaugagcauucaguugaucaacaaggcagugaaugccuugauaaaugaucaacuuauaaugaagaaccaucugcgagacaucaugggaauuccauacuguaauuauagcaaauauugguaccucaaccacacaacuacugggaaaacaucacugccuaaauguuggcuuguaucaaaugggucauacuugaacgagacccacuuuucugaugauauugaacaacaagcugacaacaugaucacugagauguuacagaaggaguauauggagaggcaggggaagacaccauugggccuaguugaccucuuuguguucagcacaaguuucuaucucaucagcaucuuccuucaccuagucaaaauaccaacucauaggcauauuguaggcaagucauguccuaaaccucacagauugaaucacaugggcauauguuccuguggacucuauaaacagcccggugugccugugaaauggaaaagauga

SEQ ID NO: 544 - RNA, 1476 nt, Artificial Sequence
  derived and/or modified CDS sequence (wt) from Lassa virus__AIT17810__GPC
augggacaaauagugacauucuuccaggaagugccccauguaauagaagaggugaugaacauuguucucauugcacuguccauacuagcaguguugaagggucuguacaaucuugcaacauguggccucguuggcuuggucacuuuccuccuguuguguggcaggucuugcacaaccagccuuuacaaagggguuuaugagcuucagacucuggaacugaacauggaaacacucaauaugaccaugccucucuccugcacaaaagacaacagucaucauuacauaagggugggcaaugagacaggacuagaacugaccuugaccaacacgagcauucuuaaucauaaauuuugcaaucugucugaugcccacaaaaagaaccucuaugaccacgcucuuaugagcauuaucucuaccuuccacuuguccaucccuaacuucaaucaguaugaggcaaugagcugcgauuucaaugggggaaggauuagugugcaguacaaccugagucacagcuacgccggggaugcagccaaccauuguggcacuguugcaaaugguguacuacagacuuucaugaggauggcuuggggugggagcuacauugcucuugacucaggccguggcaggugggacuguauuaugacuaguuaucaauaucugauaauucaaaauacaaccugggaagaucacugccaauucucgagaccaucucccaucgguuaucucgggcuucucucacaaaggaccagagauauuuauauuaguagaaggcuacugggcacauucacauggacacugucagauucugaaggcaaagacacaccagggggguauugucugaccagauggaugcuaauugaggcugaacuaaaguguuucgggaacacagcuguggcaaaauguaaugagaagcaugaugaagaauuuugugacaugcugaggcuguuugacuucaacaagcaagccauucaaagguugaaagcugaggcacaaaugagcauucaguugaucaacaaagcaguaaaugcuuugauaaaugaccaacuuauaaugaagaaccaucuacgggacaucauggggauuccauacuguaauuacagcaaguauugguaccucaaucacacaacuacugggaaaacaucacugcccagauguuggcuuguaucaaaugguucauacuugaacgagacccacuuuucugaugauauugaacaacaagcugacaacaugaucacugagauguuacagaaggaguacauggagaggcaggggaagacaccauugggucuaguugaccucuuuguguucagcacaaguuucuaucucauuagcaucuuccuccaccuagucaaaauaccaacucauaggcauguuguaggcaagccgugucccaaaccucacagguugaaucauaugggcauuuguuccuguggacucuauaaacagccuggugugccugugaaauggaagagauga

SEQ ID NO: 545 - RNA, 1476 nt, Artificial Sequence
  derived and/or modified CDS sequence (wt) from Lassa virus__AIT17814__GPC
augggacaaauagugacauucuuccaggaagugccccaugucauagaagaggugaugaacauuguucucauugcacuguccauacuagcagugcugaaaggucuguacaauuuugcaacauguggccucguuggcuuggucacuuuccuccuguuguguggcaggucuuguacaacuagccuuuacaaagggguuuaugagcuucagacucuggaacuaaacauggaaacacucaauaugaccaugccucucuccugcacaaagaacaauagucaucauuauauaauggugggcaaugagacaggacuagaacugaccuugaccaacacgagcauuauugaucauaaauuuugcaaucugucugaugcccacagaaagaaccucuaugaccacgcucuuaugagcauuaucucaacuuuccacuugucuaucccuaacuucaaucaguaugaggcaaugagcugcgauuucaaugggggaaagauuaguguacaguacaaccugagucacagcuaugccaaggacgcagccgaccauuguggaacuguugcaaaugguguauuacagacuuucaugaggauggcuuggggugggagcuacaucgcucuugacucaggccguggcaggugggacuguauuaugacuaguuaucaauaucugauaauccaaaauacaaccugggaagaucacugccaauucucgagaccaucucccaucgguuaucucgggcuccucucacagaggaccagagauauuuauauuaguagaaggcuacuaggcacauucacauggacacugucagauucugaaggcaaggacacaccagggggauauugucuaaccagauggaugcuaauugaggcugagcuaaagugcuucgggaauacagcuguggcaaaauguaaugagaagcaugaugaggaauuuugugacaugcugagguuguuugacuuuaacaagcaagccauucaaagguugaaagcugaagcacaaaugagcauucaguugaucaacaaagcaguaaaugcuuugauaaaugaccaacuuauaaugaagaaccaucuacgggacaucauggggauuccauacuguaauuacagcaaguauugguaccucaaccacacaacuacuggaaaaacaucacugcccaaguguuggcuuguaucaaaugguucauaccugaacgagacccacuuuucugaugacauugaacaacaagcugacaacaugaucaccgagauguuacagaaggaguauauggagaggcaggggaagacaccauugggucugguugaccucuuuguguucagcacaagcuucuaucucauuagcaucuuccuucaccuaguuaaaauaccaacucauaggcauauuguaggcaagccgugucccaaaccucacagguugaaucauaugggcauuuguuccuguggacucuauaaacagccuggugugccuguaaaauggaagagauga

SEQ ID NO: 546 - RNA, 1476 nt, Artificial Sequence
  derived and/or modified CDS sequence (wt) from Lassa virus__AIT17820__GPC
augggacagauagugacauucuuucaggaagugccucauguaauagaagaggugaugaacauuguucucauugcgcugucuauauuagcagugcugaaaggucuauacaacuuugcaacauguggccucguugguuugguuacuuuucuccuguuguguggcaggucuugcacaaccagucuuuauaaaggggucuaugagcuucagacucuggaguuaaacauggagacacucaauaugaccaugccucucuccugcacaaagaauaacagucaucauuacauaaugguaggcaaugagacaggacuagaacugaccuugaccaacacaaguauuauuaaucauaaauuuugcaaucugucugaugcccacaaaaagaaccucuaugaccaugcucuuaugagcauaauuucaacuuuccacuuguccauccccaacuucaaucaguaugaggcaaugagcugcgauuuuaaugggggaaagauuagugugcaguacaaccugagucacagcuaugcugaggaugcugccaaccauuguggcacuguugcaaauggugucuuacagacuuucaugagaauggcuuggggugggagcuacauugcucuugacucaggccguggcaauugggauugcauuaugacuaguuaucaauaucugauaauucaaaauacaaccugggaagaucacugccaauucucaagaccaucuccuaucgguuaucuugggcuccucucacaaaggaccagagauauuuauaucaguagaagacuacuaggcacauucacauggacacugucagauucugaaggcaaggacacaccagggggauauugucugaccagauggaugcugauugaagcugaauuaaaauguuucgggaacacagcuguggcaaaauguaaugagaagcaugaugaggaauuuugugacauguugaggcuguuugacuucaacaaacaagccauucaaagguugaaagcugaagcacaaaugagcauucaguugaucaauaaggcaguaaaugccuugauaaaugaucaacuuauaaugaagaaccaucuacgggacaucaugggaauuccauacuguaauuacagcaaauauugguaccucaaccacacaacuacugggaaaacaucacugccuaaauguuggcuuguaucaaaugggucauacuugaacgagacccacuuuucugaugauauugaacaacaagcugacaacaugaucacugagauguuacagaaggaguauauggagaggcaggggaagacaccauugggccuaguugaccucuuuguguucagcacaaguuucuaucucaucagcaucuuccuucaccuagucaaaauaccaacucauaggcauauuguaggcaagucauguccuaaaccucacagauugaaucacaugggcauauguuccuguggacucuauaaacagcccggugugccugugaaauggaaaagauga

SEQ ID NO: 547 - RNA, 1476 nt, Artificial Sequence
  derived and/or modified CDS sequence (wt) from Lassa virus__AIT17824__GPC
augggacagauagugacauucuuccaggaagugccucauguaauagaagaggugaugaacauuguccucauugcgcugucuauauuagcagugcugaaaggucuguacaacuuugcaacauguggccucguugguuugguuacuuuccuccuguuguguggcaggucuugcacaaccaguguuuauaaaggggucuaugagcuucagacucuggaguuaaacauggagacacucaauaugaccaugccucucuccugcacaaagaauaacagucaucauuauauaaugguagguaaugagacaggacuagaacugaccuugaccaacacaagcauuauuaaucauaaauuuugcaaucugucugaugcccacaaaaagaaccucuaugaccaugcccuuaugagcauaauuucaacuuuccacuuguccauccccaacuucaaucaguaugaagcaaugagcugugauuucaaugggggaaagauuagugugcaguacaaccugagucacagcuaugcuggggaugcugccaaccauuguggcacuguugcaaauggugucuuacagacuuucaugaggauggcuuggggugggagcuacauugcucuugacucaggccauggcaagugggacuguauuaugacuaguuaucaauaucugauaauccaaaauacaaccugggaagaucacugccaauucucaagaccaucuccuaucgguuaucuugggcuucucucacaaaggaccagagauauuuauaucaguagaagacuacuaggcacauucacauggacacugucagauucugaaggcaaggacacaccagggggauauugucugaccagauggaugcugauugaagcugaauuaaaaugcuucgggaacacagcuguagcaaaauguaaugagaagcaugaugaggaauuuugugacauguugaggcuguuugacuucaacaaacaagccauucaaagguugaaagcugaagcacaaaugagcauucaguugaucaacaaggcaguaaaugccuugauaaaugaucaacuuauaaugaagaaccaucuacgggacaucaugggaaucccauacuguaauuacagcaaauauugguaccucaaccacacaacuacugggaaaacaucacugccuaaauguuggcuugucucaaaugggucauacuugaacgagacccacuuuucugaugauauugaacaacaagcugacaacaugaucacugagauguuacagaaggaguauauggagaggcaggggaagacaccauugggccuaguugaccucuuuguguucagcacaaguuucuaucucaucagcaucuuccuucaccuagucaaaauaccaacucauaggcauauuguaggcaagucguguccuaaaccucacagauugaaucacaugggcauauguuccuguggacucuacaaacagcccggugugccugugagauggaaaagauga

SEQ ID NO: 548 - RNA, 1476 nt, Artificial Sequence
  derived and/or modified CDS sequence (wt) from Lassa virus__AIT17828__GPC
augggacagauagugacauucuuccaggaagugccucauguaauagaagaggugaugaacauuguucucauugcgcugucuauauuagcagugcugaaaggucuauacaacuuugcaacauguggccucguugguuugguuacuuuucuccuguuguguggcaggucuugcacaaccagucuuuauaaaggggacuaugagcuucagacucuggaguuaaacauggagacacucaauaugaccaugccucucuccugcacaaagaauaacagucaucauuacauaaugguaggcaaugagacaggacuagaacugaccuugaccaacacaaguauuauuaaucauaaauuuugcaaucugucugaugcccacaaaaagaaccucuaugaccacgcucuuaugagcauaauuucaacuuuccacuuguccauccccaacuucaaucaguaugaggcaaugagcugcgauuuuaaugggggaaagauuagugugcaguacaaccugagucacagcuaugcuggggaugcugccaaccauuguggcacuguugcaaauggugucuuacagacuuucaugagaauggcuuggggugggagcuacauugcucuugacucaggccguggcaauugggauugcauuaugacuaguuaucaauaucugauaauucaaaauacaaccugggaagaucacugccaauucucaagaccaucuccuaucgguuaucuugggcuccucucacaaaggaccagagauauuuauaucaguagaagacuacuaggcacauucacauggacacugucagauucugaaggcaaggacacaccagggggauauugucugaccagauggaugcugauugaagcugaauuaaaauguuucgggaacacagcuguggcaaaauguaaugagaagcaugaugaggaauuuugugacauguugaggcuguuugacuucaacaaacaagccauucaaagguugaaagcugaagcacaaaugagcauucaguugaucaauaaggcaguaaaugccuugauaaaugaucaacuuauaaugaagaaccaucuacgggacaucaugggaauuccauacuguaauuacagcaaauauugguaccucaaccacacaacuacugggaaaacaucacugccuaaauguuggcuuguaucaaaugggucauacuugaacgagacccacuuuucugaugauauugaacaacaagcugacaacaugaucacugagauguuacagaaggaguauauggagaggcaggggaagacaccauugggccuaguugaccucuuuguguucagcacaaguuucuaucucaucagcaucuuccuucaccuagucaaaauaccaacucauaggcauauuguaggcaagucauguccuaaaccucacagauugaaucacaugggcauauguuccuguggacucuauaaacagcccggugugccugugaaauggaaaagauga

SEQ ID NO: 549 - RNA, 1473 nt, Artificial Sequence
  derived and/or modified CDS sequence (wt) from Lassa virus__AIT17836__GPC
auggggcagauuauuacauucuuucaagaagugccacauguaauagaggaagucaugaacauugugcuaauugcgcuuucucuauuggcaaucuugaagggcuuguauaacaucgcuacaugugggauuauuggauugguugccuuuuuauucuuguguggcaagucuuguucccuaacccuuaaagggggauaugagcugcaaaccuuagaauuaaauauggagacccuaaacaugaccaugcccuuaucaugcaccaagaacagcagucaucauuacauaagagugggcaaugagacuggauuagaauugacuuuaacuaacaccagcauuauaaaucacaaauuuugcaacuuauccgaugcucacaaaaagaaucuuuaugaucaugcucucaugagcaucaucucaacauuccaucuauccauuccaaacuucaaucaguaugaagccaugaguugugauuucaauggagggaaaaucagugugcaauacaaccucucucauuccuaugcuggggaugcggccgaacacugugggacaguugccaacggaguguugcaaacauuuaugagaauggccugggguggaagauacauugcauuagacucaggaaagggaaacugggacuguauaaugaccagcuaccaguaccugauaauucaaaauacaacaugggaggaccacugccaauucucaagaccgucuccuaucggguaccuuggccuuuugucacaaaggacaagagauauauauauaaguaggaggcucuuggggaccuucaccuggacauugucagauucugagggcaaugaaacaccaggugguuauuguuuaaccagguggaugcuaauugaagcagaacucaaguguuuugggaauacagcuguggcaaaaugcaaugagaagcaugaugaggaguuuugugacaugcugagauuguuugauuucaacaagcaagcaauccguagguugaaggcugaggcccagaugaguauucaauuaauaaauaaagccgugaaugccuuaaucaaugaucaauuaaucaugaagaaccauuuaagagacaucaugggcauucccuacugcaauuacagcaaguauugguaccuuaaucauacuaguagcgggagaacaucacuaccaaaguguuggcuuauauccaaugggucauaucuaaaugaaacccaguucucugaugacauagaacagcaagccgacaauaugaucacagagaugcuucagaaagaauacauugaaagacaagggaaaacgcccuugggacuaguggacauuuucaucuuuagcacaagcuuuuaucugaucagcauuuucuugcauuuaauuaaaaucccuacacaucgacacaucguugggaaacccugucccaaaccccauagacuaaaucacaugggaguauguuccuguggacuguacaaacacccugguguuccaacaaaguggaagagauag

SEQ ID NO: 550 - RNA, 1476 nt, Artificial Sequence
  derived and/or modified CDS sequence (wt) from Lassa virus__AIT17840__GPC
augggacaaauagugacauucuuccaggaagugccccaugucauagaagaggugaugaacaucguucucauugcacugucuauacuagcaguguugaaaggucuguacaauuuugcaacauguggccucguuggcuuggucacuuuccuccuguuguguggcaggucuugcacaauuagccuuuacaaggggguuuaugagcuucagacucuggaacuaaacauggaaacacucaauaugaccaugccucucuccuguacaaagaacaacagucaucauuauauaauggugggcaaugagacaggacuagaacugaccuugaccaacacgagcauuauuaaucauaaauuuugcaaucugucugaugcccacaaaaagaaccucuaugaccaugcucuuaugagcauuaucucaacuuuccacuuguccaucccuaacuucaaucaguaugaggcaaugagcugcgauuucaaugggggaaagauuagugugcaguacaaccugagucacagcuaugccggggacgcagccaaccauugugguacuguugcaaaugguguauuacagacuuucaugaggauggcuuggggugggagcuacaucgcucuugacucaggccgugacaggugggacuguauuaugacuaguuaucaauaucugauaauccaaaauacaaccugggaagaucacugccaauucucgagaccaucucccaucgguuaucucgggcuccucucacaaaggaccagagauauuuauauuaguagaaggcuacuaggcacauucacauggacacugucagauucugaaggcaaggacacaccagggggauauugucuaaccagauggaugcuaauugaggcugagcuaaagugcuucgggaacacagccguggcaaaauguaaugagaagcaugaugaggaauuuugugacaugcugagguuguuugacuuuaacaaacaagccauucaaagguugaaagcugaagcacaaaugagcauucaguugaucaacaaagcaguaaaugcuuugauaaaugaccaacuuauaaugaagaaccaucuacgggacaucauggggauuccauacuguaauuacagcaaguauugguaccucaaccacacaacuacuggaaaaacaucacugcccaaguguuggcuuguaucaaaugguucauaccugaacgagacccacuuuucugaugacaucgaacaacaagcugacaacaugaucacugagauguuacagaaggaguauauggagaggcaggggaagacaccauugggucugguugaccucuuuguguucagcacaagcuucuaucucauuagcaucuuccuucaccuaguuaaaauaccaacucauaggcauauuguaggcaagccgugucccaaaccucacagguugaaucauaugggcauuuguuccuguggacucuauaaacagccuggugugccugugaaauggaagagauga

SEQ ID NO: 551 - RNA, 1476 nt, Artificial Sequence
  derived and/or modified CDS sequence (wt) from Lassa virus__AIT17844__GPC
augggacaaauagugacauucuuccaggaagugccccaugucauagaagaggugaugaacaucguucucauugcacugucuauacuagcaguguugaaaggucuguacaauuuugcaacauguggccucguuggcuuggucacuuuccuccuguuguguggcaggucuugcacaauuagccuuuacaaggggguuuaugagcuucagacucuggaacuaaacauggaaacacucaauaugaccaugccucucuccuguacaaagaacaacagucaucauuauauaauggugggcaaugagacaggacuagaacugaccuugaccaacacgagcauuauuaaucauaaauuuugcaaucugucugaugcccacaaaaagaaccucuaugaccaugcucuuaugagcauuaucucaacuuuccacuuguccaucccuaacuucaaucaguaugaggcaaugagcugcgauuucaaugggggaaagauuagugugcaguacaaccugagucacagcuaugccggggacgcagccaaccauugugguacuguugcaaaugguguauuacagacuuucaugaggauggcuuggggugggagcuacaucgcucuugacucaggccgugacaggugggacuguauuaugacuaguuaucaauaucugauaauccaaaauacaaccugggaagaucacugccaauucucgagaccaucucccaucgguuaucucgggcuccucucacaaaggaccagagauauuuauauuaguagaaggcuacuaggcacauucacauggacacugucagauucugaaggcaaggacacaccagggggauauugucuaaccagauggaugcuaauugaggcugagcuaaagugcuucgggaacacagccguggcaaaauguaaugagaagcaugaugaggaauuuugugacaugcugagguuguuugacuuuaacaaacaagccauucaaagguugaaagcugaagcacaaaugagcauucaguugaucaacagagcaguaaaugcuuugauaaaugaccaacuuauaaugaagaaccaucuacgggacaucauggggauuccauacuguaauuacagcaaguauugguaccucaaccacacaacuacuggaaaaacaucacugcccaaguguuggcuuguaucaaaugguucauaccugaacgagacccacuuuucugaugacaucgaacaacaagcugacaacaugaucacugagauguuacagaaggaguauauggagaggcaggggaagacaccauugggucugguugaccucuuuguguucagcacaagcuucuaucucauuagcaucuuccuucaccuaguuaaaauaccaacucauaggcauauuguaggcaagccgugucccaaaccucacagguugaaucauaugggcauuuguuccuguggacucuauaaacagccuggugugccugugaaauggaagagauga

SEQ ID NO: 552 - RNA, 1473 nt, Artificial Sequence
  derived and/or modified CDS sequence (wt) from Lassa virus__AMR44577__GPC
auggggcaaauaauaaccuucuuccaggagguuccucauguuauagaggaggugaugaacauuguucugauagcacucucacuccuagcuauccugaaaggggucuacaauguggcaacaugugggauaauugggcuugugaccuuccucuuucucuguggaagaucuuguucacugaucuacaaaggcaguuaugagcugcaaacauuggaguuaaauauggagacccuaaacaugaccaugccucugucaugcacuaaaaauaguagccaccauuauauucgaguugggaacgagacuggcuuagagcugacauugaccaacaccagcauuauaaaucacaaauucuguaaccugucagaugcucacaaacguaaucuguaugaccacgcacucaugagcauccuuuccacauuccaucuguccaucccaaacuucaaccaguaugaggcgaugaguugugacuucaauggaggcaaaaucagugugcaauauaaucucagccaugcuuaugcaguugaugcugccgaacacugcggaacaguugcaaauggugugcuacaaacauucaugaggauggcuuggggaggaaguuacauugcacuugacucugggagaggcaauugggacuguauuaugacaagcuaccaauacuuaaucauucagaauacaacaugggaagaucacugccaauuuucaagaccuucuccuauugguuaucucggcuuauugucacaaagaacaagagacauuuauaucaguaggaggcugcuggguacauucaccuggacacuuucugacucagagggaaaugagacaccaggcggauacuguuuaacaagauggaugcugauagaggcugagcuaaaauguuuuggaaacacagcuguugcaaaguguaaugagaagcaugaugaggaauucugcgacauguuaagguuguuugacuucaacaaacaggcaauucagaggcucaaaucagaggcacaaaugagcauccaguuaauaaauaaagcagugaaugcauugauaaaugaucagcucauuaugaagaaccacuuaagggauaugauggguauaccguauugcaacuacaguaaguauugguaucucaaucacaccucaucagggagaacaucguugccuaaaugcuggcuuguuuccaauggaaguuaucugaaugagacccacuucucagaugauauugaacaacaggcagacaacaugauaacugaaauguuacaaaaggaauauaucgauaggcaggguaaaacaccuuuaggacuuguugaccuuuuuguuuucagcacgaguuuuuaccuuauaaguauauucuuacacuugauaaagauaccuacucauaggcacauaguuggaaagccaugccccaagccacaccgccucaaccacauggggaucugcucuuguggacuauacaagcagccuggugucccaaccagauggaagagauaa

SEQ ID NO: 553 - RNA, 1476 nt, Artificial Sequence
  derived and/or modified CDS sequence (wt) from Lassa virus__ANH09722__GPC
auggggcaaauugugacauucuuucaggaagugccucauguaauugaggaggugaugaacauuguacucauugcacuauccauacuggcagugcuaaagggucuguacaauguugcaacauguggccucauuggcuugguuaccuuccuccugcugugugguagaucuuguacaaccacucuuuauaaagggguuuaugagcuucaagcucuggaacuaaacauggaaacacucaacaugacuaugccucucucuugcacaaaaaacaacucucaucacuauauaagggugggcaaugaaacaggccuagaacugaccuugaccaacacaagccucauaaaucacaaguucugcaaucugucugaugcucacaaaaagaaccucuaugaucaugcucuuaugagcauaaucucaacuuuccauuuguccauccccaacuucaaucaguaugaagcaaugagcugugauuucaaugaugggaagaucaguguacaguacaaccuaagccacaccuacgcuggggauacagccaaccacugugguacuguugcgaacgguguuuuacagacuuucaugaggauggcuuggggugggaguuacauugcucuugauucaggccgugguggaugggacugcauuaugaccagcuaucaauauuugauaauucagaacacaaccugggaagaucacugucaguucucaagaccaucucccaucggguaccuugggcuccucucacaaagaaccagagacauuuauaucaguagaagacuacugggcacauucacauggacacuaucagauucugaggguaaagacacaccagggggguacugucuaacuagguggaugcugauugaagcugaauugaaaugcuuuggcaacacagcuguagcaaaaugcaaugagaagcaugaugaggaauuuugugauauguugaggcuauuugacuuuaacaaacaagccauucaaagauugaaagcugaagcacaaaugaguauucagcugaucaacaaagcagugaaugccuugauaaaugaucaacugauaaugaaaaaccauuugcgggacauuauggggauuccguacugcaacuacagcaaguauugguaucuuaaucacacagucaccggaaagacaucauuacccaaaugcuggcuuguaucaaauggcucauaccuaaacgagacccacuucucugaugauauugagcagcaagcugauaacaugauuacugagaugcuacagaaggaauacauggagagacaggggaagacaccacuuggucugguugaccucuuuguauuuagcacaaguuucuaucucauuagcauuuuccuucaccuagugaaaauaccaacucauaggcauguugugggcaaaccguguccuaaaccucacagacugaaccacauggguauauguucuuguggguucuacaagcaaccuggugugccugugagauggaagagauga

SEQ ID NO: 554 - RNA, 1476 nt, Artificial Sequence
  derived and/or modified CDS sequence (wt) from Lassa virus__ANH09724__GPC
auggggcagauugugacauucuuccaggaagugccucauguaauagaggaggugaugaacauuguacucaucgcacugucuauacuagcagugcugaagggucuguauaauguugcaacauguggccucauuggcuugguuacuuuccuucugcugugugguagaucuugcacaaccacucuuuauaaagggguuuaugagcuucaagcucuggaacugaacauggaaacacucaacaugacuaugccucucucuugcacaaaaaacgacagucaucacuauauaauggugggcaaugaaacaggccuagaacugacuuugaccaacacaagcaucaucagucauaaguucugcaaucuguccgaugcucacaaacagaaccucuaugaucaugcucucaugagcauaaucucaacuuuccauuuguccaucccuaacuucaaucaguaugaagcaaugagcugugacuuuaauggugggaagaucaguguacaguacaaccuaagccauaccuaugcuggagaugcagccaaccauuguggcacuguugcaaaugguguuuuacagacuuucaugaggauggcuuggggugggaguuacauugcucuugauucaggccgugguggaugggauugcauuaugacuagcuaucaauauuugauaauucagaauacaaccugggaagaucacugucaguuuucaaggccaucucccaucggguaccuugggcuccuuucacaaagaaccagagacauuuauaucaguagaagacuccugggcacauucacauggacgcugucagauuccgaggguaaagacacaccagggggcuacugucugaccagguggaugcugauugaagcugaauugaaaugcuuuggcaacacagcuguggcaaaaugcaaugagaagcaugaugaggaauuuugugacauguugaggcuauuugacuucaacaaacaagccauucaaagguugaaggcugaagcacaaaugaguauucagcuaaucaacaaagcagugaaugccuugauaaaugaucaacuaauaaugaagaaccaucugcgggauauuauggggauuccguacugcaacuacagcaaguauugguaucuuaaccacacagucaccgggaaaacaucgcugccuaaaugcuggcuuguaucaaaugguucauaccuaaaugagacucacuucucugaugauauugagcagcaggcugauaacaugaucacugagaugcugcaaaaggaauacauggagaggcaggggaagacaccauugggucugguugaccucuuuguauuuagcacaaguuucuaucucaucagcaucuuucuucaccuagucaaaauaccaacucauaggcauguugugggcaaaccguguccuaaaccucacagacugaaccacauggguauaugcucuuguggauucuauggacaaccugguguaccuguaagauggaagagauga

SEQ ID NO: 555 - RNA, 1476 nt, Artificial Sequence
  derived and/or modified CDS sequence (wt) from Lassa virus__ANH09728__GPC
auggggcaaauugugacauucuuucaggaagugccucaugugauugaggaggugaugaacauuguacucaucgcauugucuguacuagcagugcuaaagggucuguauaauguugcaacauguggccuuauuggcuuggucaccuuucuucugcugugugguagaucuugcacaacuacccuuuauaaagggguuuaugagcuucaagcucuggaacugaacauggggacacucaacaugacuaugccucucucuuguacaaaaaacaacagucaucacuauauaaugguaggcaaugaaacaggccuggaacugacuuugaccaacacaaguaucaucaaucacaaguucugcaaucugucugaugcucacaaaaaggaccucuaugaucaugcucuuaugaguauaaucucaacuuuccacuuguccgucccuaacuucaaucaguaugaagcaaugaguugugauuucaauggggggaagaucaguguacaauacaaccuaagccaugccuaugcuggagauacagccaaccacuguggcaccguugcaaacggcguuuuacagaccuucaugaggauggcuuggggugggaguuacauugcucuugauucaggccgugguggaugggacugcauuaugaccagcuaucaauauuugauaauucaaaacacaaccugggaagaucacugucaguuuucaagaccaucucccaucggguaccuugggcuccucucacaaagaaccagagacauuuauaucaguagaagacuacugggcacauucacauggacacugucagauucugagggugaauacacaccagggggguacugucuaacuagguggaugcugauugaagcugaauugaaaugcuuuggcaacacagcuguagcaaaaugcaaugagaagcaugaugaggaauuuugugauauguugaggcuauuugacuucaacaaacaagcuauucagagguugaaagcugaagcacaaaugaguauucagcugauaaacaaagcagugaaugccuuaauaaaugaucaacugauaaugaagaaccaucugcgggacauuauggggauuccauacugcaacuacaguaaguauugguaucuuaaccacacagucaccgggaaaacaucauugcccaaaugcuggcuuguaucaaauggcucauaccuaaacgagacccacuucucugaugauauugagcagcaggcugauaacaugauuacugagaugcugcagaaggaauacauggagaggcaggggaagacaccauuggguuugguugaccucuuuguauuuagcacaaguuucuaucucauuagcauuuuccuucaucuugucaaaauaccaacucauaggcauguugugggcaaaccgugucccaaaccucacagacugaaccacauggguauauguucuuguggguucuauaaacaaccuggugugccuguaagauggaagagauga

SEQ ID NO: 556 - RNA, 1476 nt, Artificial Sequence
  derived and/or modified CDS sequence (wt) from Lassa virus__ANH09730__GPC
auggggcaaauugugacauucuuucaggaagugccucaugugauugaggaggugaugaacauuguacucaucgcacugucuguacuagcagugcuaaagggucuguauaacguugcaacauguggucucauuggcuuggucaccuuucuucugcugugugguagaucuugcacaaccacccuuuauaaagggguuuaugagcuucaagcucuggaacugaacauggagacacucaacaugacuaugccucucucuugcacaaaaaacaacagucaucacuauauaaugguaggcaaugaaacaggccuggaacugacuuugaccaacacaagcauuaucaaucacaaguucugcaaucugucugaugcucacaaaaagaaccucuaugaucaugcucuuaugagcauaaucucaacuuuccacuuguccaucccuaacuucaaucaguaugaagcaaugagcugugauuuuaaucaggggaagauuaguguacaauacaaccuaagccaugccuaugcuggagaugcagccaaccacuguggcacuguugcaaacggcguuuuacagacuuucaugaggauggcuuggggugggaguuacauugcucuugacucaggccgugguggaugggacugcaucaugaccagcuaucaauauuugauaauucagaacacaaccugggaaaaucacugucaguucucaagaccaucucccauuggguaccuugggcuccucucacaaagaaccagagacauuuauaucaguagaagacuacuuggcacauucacauggacacugucagauucugaggguaaaggcacaccagggggguacugucuaacuagguggaugcugauugaagcugaguugaaaugcuuuggcaacacagcuguagcaaaaugcaaugagaagcaugaugaggaauuuugugacauguugaggcuauuugacuucaacaaacaagccauucagagguuuaaagcugaagcacaaaugaguauucaguugaucaauaaagcagugaaugccuugauaaaugaucaacugauaaugaagaaccaucugcgggacauuauggggauuccauacugcaacuacagcaaguauugguaucuuaaccacacagucaccgggaaaacaucauugcccaaaugcuggcuuguaucaaauggcucauaccuaaacgagacccacuucucugaugauauugagcagcaggcugauaacaugauuacugagaugcugcagaaggaauacauggagaggcaggggaggacaccauugggucugguugaccucuuuguauuuagcacaaguuucuaucuuauuagcauuuuccuucaucuugucaaaauaccaacucacaggcauguugugggcaagccgugucccaaaccucacagacugaaucacauggguauauguucuuguggguucuauaaacaaccuggugugccuguaagauggaagagauga

SEQ ID NO: 557 - RNA, 1476 nt, Artificial Sequence
  derived and/or modified CDS sequence (wt) from Lassa virus__ANH09732__GPC
auggggcaaauugugacauucuuucaggaagugccucauguaauagaggaggugaugaacauuguacucaucgcacugucuauacuagcaguguuaaaggguguguauaauguugcaacauguggccucauuggcuugguuaccuuccuuuuacugucugguagaucuugcacaaccacuauuuauaaagggguuuaugagcuucaagcucuggaacugaacauggagacacuuaacaugacuaugccccucucuugcacaaagaauaacagucaucacuauauaauggugggcaaugaaacagguuuagaacugacuuugaccaacacaaguaucauuaaucauaaguucugcaauuugucugaugcccacaaaaagaaccuuuaugaucaugcucuuaugagcauaaucuccacuuuccauuuauccaucccuaacuuuaaucaguaugaagcaaugagcugugauuuuaauggugggaagaucagugugcaguacaaccuaagccauaccuaugcuggagaugcagccaaccacuguggcacuguugcaaaugguguuuuacagacuuucaugaggauggccuggggugggaguuacauugcucuugauucaggccaugguggaugggauugcauuaugaccagcuaucaauauuugauaauucagaacacaaccugggaaaaucacugucaguucucaagaccaucccccaucggguaccuugggcuccucucacaaagaaccagagacauuuauaucaguagaagacuacugggcacauucacauggacacugucagauucugaagguaaagacacaccagggggguacugucugacuagguggaugcugauugaagcugaauugaaaugcuuuggcaacacagcuguagcaaaaugcaaugagaagcaugaugaggaauucugugacauguugaggcuauuugacuucaacaaacaagccauucaaagguugaaagcugaggcacagaugaguauucagcugaucaacaaagcagugaaugccuuaauaaaugaucaacugauaaugaagaaccaucugcgggacauuauggggauuccauacugcaacuacagcaaguauugguaccuuaaccacacagucaccgggaaaacaucauugccuaaaugcuggcuuguaucaaauggcucauaccuaaacgagacccacuucucugaugauauugagcagcaggcugauaacaugauuacugagaugcuacagaaggaauacauggaaaggcaggggaagacaccacugggucuaguugaccuuuuuguguuuagcacaaguuucuaucucauuagcaucuuccuccaccuagucaaaauaccaacucauaggcacauuguuggcaaaccguguccuaaaccucacagacugaaccacauggguauauguucuuguggguucuauaaacaaccugguguaccuguaagauggaagagauga

SEQ ID NO: 558 - RNA, 1473 nt, Artificial Sequence
  derived and/or modified CDS sequence (wt) from Lassa virus__ANH09738__GPC
auggggcagauagugacauucuuccaagaaguuccucaugucauugaggaaaucaugaacaucguucuaaucacuuugucccuacuugcaaucuugaagggacuguacaacuuugcuacguguggucucauuggauugauaacauuccuuuuccucugugggagaucaugcucgaugauuuacaaaggaagcuaucaacuugaaacccuugaguugaacauggagacacuuaacaugaccaugcccuuauccugcacaaaaaacaacagucaccacuauauaagaguggguaaugaaacagggcucgaauugacucuaaccaacacaagcauuauaaaccacaaguuuugcaaucuuucugaugcacacaaaaggaaccuuuaugaucauucucucaugagcaucaucuccacuuuucaccugucuauccccaacuucaaucaauaugaggccaugagcugugacuucaauggggguaaaaucagcauucaguacaaccuaagucacacauaugcaggggaugcagcuaagcauuguggcacuguagcaaaugguguguugcaaaccuucaugagaauggcuuggggcgggaguuauauugcacuugacucaggccgagggaauugggacugcauaaugaccagcuaccaauacuuaaucauucaaaacacgaccugggaggaccacugucaguucucuagaccaucaccuauugguuaucuugggcuucucucccaaaggacuagagacauuuacauuagcaggagacuguuagggacauucacauggacgcuaucagacucugaaggcaaagaaaccccaggagguuacugcuuaaccagauggaugcuaauugaagcugaacugaaauguuuuggaaacaccgcaguagccaaaugcaaugaaaaacaugaugaagaguuuugugacaugcugaggcucuuugacuuuaacaagcaagccauucagagauugaaaacugaggcucagaugagcauucagcucauuaauaaagcagugaaugcucucauaaaugaccagcuuauaaugaaaaaccaucuucgagacauuauggguauaccauacugcaauuacaguaaauacugguaucucaaccacacgucuacaggcagaacuucacuaccaaagugcuggcuuguuucaaauggauccuaucucaaugaaacucacuuuucagaugauauagagcaacaagcugacaauaugauaacggaaauguuacagaaggaauacauugauagacaggggaagacuccacucggacuaguugacguguuuauguucaguacaagcuucuauuugaucagcauuuuccuucaucuaguuaaaauaccaacucauaggcacauugugggcaaaucaugucccaaaccccauagacuaaaucacauggguauuuguucuugugggcuguacaaacaaccaggaguaccugugagauggaagagauaa

SEQ ID NO: 559 - RNA, 1473 nt, Artificial Sequence
  derived and/or modified CDS sequence (wt) from Lassa virus__ANH09740__GPC
augggucaaauagugaccuucuuccaggaaguaccucauguuauagaggaagugaugaacauaguucugauagcacuuucucucuuagccauccugaagggccucuacaauuuugccaccuguggaguaauuggacugauaacauuccuuuuacuuuguggaagauccuguucagcgaccuacaaaggccaauaugaacuccaaacuuuagaacuaaauauggagucccuaaacaugaccaugccacugucuugcacaaaaaacaacagucaucauuauaucagagcuggcaacaacacaggccuggaguugacccucaccaacaccagcauuauaucucauaaauucugcaaccuuucugaugcucacaagaagaaccuuuaugaccacacucuuaugaguauaauaacuaccuuucauuuguccaucccaaauuucaaccaguaugaggcaaugaguugugacuuuaacggugggaaaaucagcauacaguacaaccucagucacuccuacgcuggugaugcugcgcaacacuguggaacaguugcaaauggggugcugcaaaccuuuaugagaauggcuuggggagguaguuaucuggcccuugauucaggaagaagagguugggacugcauaauuuccaguuaccaauacuugaucauccaaaacacaacuugggaugaccauugccaguuuucaaggccauccccgaucggguaucuuggguuuguaucgcagaagaccagggacaucuauauaaguagaagacuccuuggaacuuuuacauggacacuuucagacuccgagggacaugacaugccaggugguuacugcuugaccagauggaugcucauugaagcugauuuaaaguguuuuggaaacacagcugucgcuaaguguaaugagaaacaugacgaggaguucugugacauguggagguuguuugacuuuaauaagcaagccauucaaaggcucaaagcagaggcccagaugaacauccagcucauaaauaaagcugucaaugcucucauaaaugaccaauugaugaugaaaaaccauuuaagggauaucaugggcauucccuauugcaauuacaguaaauucugguaucucaauaacaccacgacugggagaaccucacugccaagaugcuggcugauuucaaauggguccuacuuaaaugagacucacuucucagaugauauugaacagcaagcugacaauaugauaacugagauguugcagaaagaauacauggacagacaaggaaaaacaccgcuaggacugguugaucucuuuguauucaguacaagcuuuuaccucauuaccauuuucuuacaucuugugaaaauaccaacccacagacacauaguuggcaagccgugcccuaaaccacacagacugaaucacaugggcaucugcuccugugggcucuacaaacagccuggugugccaguacgauggaagagauga

SEQ ID NO: 560 - RNA, 1473 nt, Artificial Sequence
  derived and/or modified CDS sequence (wt) from Lassa virus__CAA36645__GPC
augggacagauugugacauucuuccaagaaguuccucauguuauugaggaagugaugaauauuguccuuauugcacuauccauccuagcaauucugaagggacuauacaauguugccacguguggcuugauagggcuugucacauuccuucuacuuucaggaaggucaugcucacugaucuacaaagggacuuacgagcugcaaacccuugaguugaauauggagacucuuaauaugaccaugccgcuauccugcacaaagaacaacagucaucauuauauaaggguggggaaugagacaggacuugagcucaccuugaccaacaccagcauucuuaaucacaaauucuguaaccucucugaugcccacaaaaggaaucuuuaugaucacagccucaugaguaucaucucuaccuuucaucuguccauucccaacuucaaucaauaugaggcaaugagcugcgauuucaauggggggaaaaucacugugcaauacaaccugagucauagcuucgcaguggaugcagcaggucacugcggcacacuugcaaauggugucuuacaaacauuuaugagaauggcuuggggagggaguuauauugcucuugauucuggacgcgguaacugggacuguauaaugaccaguuaccaauaucuaaucauucagaauacaaccugggaugaccacugccaauuuuccagaccaucaccuauuggcuaccuugggcuucucucacaaagaacuagagacauauacauuagcagaagguuguuggggacauucaccuggacacuaucagacucagagggaaaugaaacaccagggggauacugccuuacuagauggauguugauugaggccgaauuaaagugcuuuggaaacacugcaguagccaagugcaaugagaaacaugaugaagaauuuugugacaugcuaagguuguucgauuucaacaaacaggccauaaggaggcucaaaacagaggcccaaaugagcauacagcugaucaacaaggcugucaaugcuuuaauaaaugaucagcucaucaugaagaaccacuugagagacaucaugggcauaccauauuguaacuacagcagauauugguaccuuaaccacacaucaacaggaaagaccucacuaccaagguguuggcuuaucucaaauggaucauaucucaaugagaccaaguuuucagaugacaucgaacaacaagcugacaacaugauaacagagaugcuacaaaaggaauacauagauagacagggcaaaacuccacugggguuaguugaccuauuuguuuuuagcacaaguuucuaucugauaagcaucuuucuccaccuggucaaaauaccaacccauagacacauuguagguaaaccuugcccaaaaccccacaggcugaaccacaugggcaucugcuccuguggucuauacaaacagccaggugugccugucagauggaagagguga

SEQ ID NO: 561 - RNA, 1476 nt, Artificial Sequence
  derived and/or modified CDS sequence (wt) from Lassa virus__NP_694870__GPC
augggacaaauagugacauucuuccaggaagugccucauguaauagaagaggugaugaacauuguucucauugcacugucuguacuagcagugcugaaaggucuguacaauuuugcaacguguggccuuguugguuuggucacuuuccuccuguugugugguaggucuugcacaaccagucuuuauaaagggguuuaugagcuucagacucuggaacuaaacauggagacacucaauaugaccaugccucucuccugcacaaagaacaacagucaucauuauauaauggugggcaaugagacaggacuagaacugaccuugaccaacacgagcauuauuaaucacaaauuuugcaaucugucugaugcccacaaaaagaaccucuaugaccacgcucuuaugagcauaaucucaacuuuccacuuguccauccccaacuucaaucaguaugaggcaaugagcugcgauuuuaaugggggaaagauuagugugcaguacaaccugagucacagcuaugcuggggaugcagccaaccauugugguacuguugcaaaugguguguuacagacuuuuaugaggauggcuuggggugggagcuacauugcucuugacucaggccguggcaacugggacuguauuaugacuaguuaucaauaucugauaauccaaaauacaaccugggaagaucacugccaauucucgagaccaucucccaucgguuaucucgggcuccucucacaaaggacuagagauauuuauauuaguagaagauugcuaggcacauucacauggacacugucagauucugaagguaaagacacaccagggggauauugucugaccagguggaugcuaauugaggcugaacuaaaaugcuucgggaacacagcuguggcaaaauguaaugagaagcaugaugaggaauuuugugacaugcugaggcuguuugacuucaacaaacaagccauucaaagguugaaagcugaagcacaaaugagcauucaguugaucaacaaagcaguaaaugcuuugauaaaugaccaacuuauaaugaagaaccaucuacgggacaucaugggaauuccauacuguaauuacagcaaguauugguaccucaaccacacaacuacugggagaacaucacugcccaaauguuggcuuguaucaaaugguucauacuugaacgagacccacuuuucugaugauauugaacaacaagcugacaauaugaucacugagauguuacagaaggaguauauggagaggcaggggaagacaccauugggucuaguugaccucuuuguguucaguacaaguuucuaucuuauuagcaucuuccuucaccuagucaaaauaccaacucauaggcauauuguaggcaagucgugucccaaaccucacagauugaaucauaugggcauuuguuccuguggacucuacaaacagccuggugugccugugaaauggaagagauga

SEQ ID NO: 562 - RNA, 1713 nt, Artificial Sequence
  derived and/or modified CDS sequence (wt) from Lassa virus__AAA46284__NP
augagugcuuccaaggaagugaggucaugcuuguggacucaaucccuaagaagggaacuaucuggcuacuguuccaacauaaaguugcagguaguuaaagacgcucaagcucuccuucauggucuugacuucuccgaggucaguaauguucagagauugaugcgcaagcagaaaagagaugauggcgaccuaaaacgacugagagaucucaaucaagcagucaacaaucuuguugagcucaaauccacacagcagaaaagugucuuaagaguuggaaccuuaaguucagacgaucuacuaauccuggccgcugauuuagaaaaacugaaaucaaaagucaccagaacagaaaggccuuugaguucaggaguuuauauggggaauuugaguucacaacagcuugaucaaaggagagcccuuuugaacaugauuggcaugacuggaguaaguggagggggaaagggugccaguaauggcauugugagaguuugggaugucaaaaaugcagaguuacucaacaaucaguucggaacaaugccaagccuaacuuuagcaugccugaccaaacaggggcaaguggaccugaaugaugccguucaagcuuugacagauuuagggcugauuuacacagccaaauaccccaacucaucugaucucgacagauugucucagagucauccaauucugaauaugauugacacuaagaaaaguucacucaacaucucugguuacaauuucaguuugggugcugcugucaaagcaggggccugcaugcuugauggugguaacauguuagagacuauuaagguuucaccucagaccauggaugguaucuugaagucaaucuugaaaguuaagaagagucugggaauguuuguaucagacacaccgggugaaaggaacccuuaugagaacauccuauacaagaucugucucucaggagacggaugguccuauauugcaucaaggaccucgauugugggaagagcaugggaaaauacugugguggaccuugagcaagacaacaagccccagaaaauuggaaaugggggguccaacaagucauuacagucugcaggcuuugcugcaggauuaaucuacucucaguugaugacucucaaagauuucaagugcuucaacuugauucccaacgcaaaaaccuggauggauauugaaggaagaccagaagacccaguugagauagcccuuuaucaaccgagcucggguugcuauguacauuucuuuagggagccaacagauuugaagcaauucaaacaagaugcaaaguauucacaugguagggaugugacugauuuguuugcugcccaaccuggguuaaccagugcagugauagaagcccuuccucggaacauggucaucacuugccaaggaucagaggauaucagaaaacuccuugagucacaagggaggagagacauaaaacugauugacaucacucuuaguaaagcagauucaagaaaguuugagaaugcuguuugggaucaauucaaggaucuaugucacaugcacacugggguaguuguggagaaaaagaagagaggugguaaagaggaaauaacuccucauugugcacugauggauugcauuauguuugaugcagcaguuucaggaggacuugaugcaaaaguccugagaguugugcucccuagagacaugguguucagaacuucaacaccuaaagucguccuguaa

SEQ ID NO: 563 - RNA, 1710 nt, Artificial Sequence
  derived and/or modified CDS sequence (wt) from Lassa virus__AAF86704__NP
augagugcuuccaaggaggugaaaucauuccuuuggacacagucauugaggagagagcuuucagguuauuguucuaacauaaagcuucaaguuguuaaggaugcccaggcccuccuucacggccuugacuucucugaggucaacaaugugcaacgucuaaugcgcaaacagaaaagagaugauggugauuuaaaacgucuuagagaccugaaucaggcagucaacaaccuuguugaacucaaaucaacacaacaaaagagcauuuugagaguuggaacacugaccucagaugacuugcugacauuggcagcugacuuagagaaacugaagucaaaagucaucagaacagaaagaccacuaagcucggguguguacauggggaauuuaaguacacagcagcuugagcagagaagggcauugcugaacaugauuggcaugguugguggagcacagggcacccaaccuggaagagacggaguuguuagggugugggaugucaaaaauccagaucucuuaaacaaccaguucggcaccaugccuaguuugacauuagcaugucuuacuaaacagggucaaguugaccuaaaugaugcuguccuagcacugacggacuugggacugauauacacagcuaaguacccuaacaguuccgaccuggacaggcuuucccaaagucauccgauacugaacaugguggacacuaagaagagcuccuugaacauuucugguuacaauuuuagcuugggagcugcaguaaaggcuggggccuguaugcucgaugggggcaacauguuggaaaccauuaagguuacgccucagacaauggaugguaucuugaaguccauuuuaaaggugaaaagaucuuugggaauguuugucucagauacaccuggugagaggaacccuuaugagaacauacuuuauaaaaucugucucucuggugauggcuggcccuacauagccucaagaaccuccauugugggcagggcuugggagaauacuacuguggaucucgagucagaugggaagccacaaaaagugggaacugcuggguccaauaagucuuugcaguccgcaggguuuccaacaggguugacuuauucacagcugaugacucuuaaagacucaaugaugcagcuugacccaagugccaaaacuuggauagacauugaaggucguccagaagacccuguggagauagcucuuuaucaaccuaugucaggcuguuacauacauuucuuuagagaaccaacagaucugaaacaguucaagcaagacgccaaguauucucaugggauugauguggcagaucuuuucccugcucaaccugguuugacuagugcaguuauugaagcucuuccucgcaauaugguguugacuugccaagguucagaugauaucaagaaacucuuagacucucaaggaaggagggacauaaagcuuauugauauuucauuaagcaagguugacucuaggaaguuugaaaaugcuguuugggaccagugcaaagacuugugccacaugcacacuggagugguuguugagaagaagaaaagaggaggcaaagaagaaaucaccccacauugugcccugauggauugcauaauguuugaugcagcugugucaggagggcucaacauaccaguuuuaagagcuguucuucccagagacaugguauuuagaaccucaagccccaaggucguccuguaa

SEQ ID NO: 564 - RNA, 1710 nt, Artificial Sequence
  derived and/or modified CDS sequence (wt) from Lassa virus__AAO59513__NP
augagugccucaaaggaaguaaaguccuucuuguggacacaaucuuugaggagggaauuguccgguuacugcuccaacaucaaacugcagguggugaaagaugcccaagcucuucugcauggacuugacuucuccgaagucaguaauguucaacggcugaugcgcaaggagagaagggaugauagugauuugaagcgguugagggaccuaaaucaagcggucaacaaccuuguugaauugaaaucaacucaacaaaagagugugcuaagaguugggacucuaaccucagaugacuugcuagucuuagcugcugaucuagagaaguugagaucaaaagugaccaggacagaaaggccauugagugcaggugucuauaugggcaaccugagcucacagcaacuugaccaaaggcgagcucuucuaaguaugauaggaaugaaugguagcaaucaaggagcucgggcugggagagaugggguggugagaguuugggaugugaaaaaugcagaguugcucaacaaucaauucgggaccaugccaagccugacacuagcauguuuaacaaaacaagggcaaguugacuugaaugaugcaguacaagcauugacagauuuggguuugaucuacacagcaaaguaucccaauacuucagaccuggauaggcugacucaaagucaccccauccuaaauaugauugauacaaagaaaagcucuuugaaugucucagguuauaacuuuagcuugggugcagcugugaaggcaggagcuugcaugcuggaugguggcaauauguuggagacaaucaaggugucaccucagacaauggauggcauccucaaauccauuuuaaaggucaagaaggcucuugggauguucauuucagacaccccuggugaaaggaacccuuaugaaaacauacucuacaagauuugucugucaggggacggguggccauauauugcaucaagaaccucaauaacaggaagagccugggaaaacacuguuguugaucuggaaucagaugaaaagccacagaaagcuggcagcaacaauuccaacaaaucccugcaaucggcaggguuuaccgcugggcuuaccuacucucagcuuaugacccucaaagaugcaaugcugcaacuugacccaaaugcuaagacuuggauggacauugaaggaagaccugaagauccgguggaaauugcccuuuaucaaccaaguucaggcugcuacauacacuucuuccgugaaccuacugauuugaagcaguucaagcaagaugcuaaauacucacaugggauugauaucacagaccucuuugcugcacaaccgggcuugaccagugcuguuauagaugcacucccccggaacauggucauuaccugucagggguccgaugacauaaggaaacuccuugagucacaaggaagaaaagacaucaaguuaauugauauugcccucaacaaagcugacuccagaaaguaugagaaugcagucugggaucaguacaaagaccuaugccacaugcacacaggugucguuguugaaaagaagaaaagaggcggcaaagaggaaauaaccccucacugugcacugauggacugcaucauguuugaugcagcaguaucaggaggacugaaaacauugguccugagagcagugcuacccagagacaugguguucagaacaucgacaccuagagucguccuguaa

SEQ ID NO: 565 - RNA, 1710 nt, Artificial Sequence
  derived and/or modified CDS sequence (wt) from Lassa virus__AAT48999__NP
augagugucucaaaggagauaaaauccuuucuguggacacagucucugaggagggaguugucggguuacugcucuaacauaaaguuacaagugguuaaagaugcucaagcucuucugcauggacucgacuucucugaggucagcaauguccagcgguugaugcgcaagcaaagaagggacgacaacgaccugaaacgacugagagaccuaaaccaggcaguuaacaaucuuguugagcugaaaucaacucaacaaaagagugugcugagaguugggacauuaacuucagaugacuuguuaauuuuagcugcugaccuggagaagcugaagucaaaggugaccaggacagaaaggccauugagcgcugguguuuacauggguaaucuaagcucacaacaacuugaucaacgacgagcucuuuugaauaugauagggaugaguggugggaaucaaggggcucagacugggagagacggaguggugaggauuugggaugugaaaaaugcagagcugcuuaacaaccaguuugggaccaugccgaguuugacacuagcuuguuuaacaaaacagggacaaguugaucugaacgauguuguucaggcauugacagaccugggcuugaucuacacagcaaaguaucccaacaccucagaccuggauagacuaacccagagccacccuauucuaaacaugauugacaccaagaaaagcucucugaauaucucagguuauaacuucagcuuaggugcagcugugaaagcaggagcuuguauguuggaugguggcaacauguuagagacaaucaaagugucaccccaaacaauggaugguauucucaaguccaucuuaaaggucaagaaagcucuugggauguuuauuucagauacucccggugagagaaacccuuaugagaacauacuuuacaagaucuguuugucaggggauggguggccauacauugcaucuaggacuucaauaacaggaagggcaugggaaaacacuguuguugauuuggaaucaggcgagaagccacaaaaaauugggagcaacaacuccaacaaaugcuuacagucugcaggguucacugcugggcuuuccuauucucagcucaugacucucaaagaugcaaugcuacagcuugacccaaaugcuaagaccuggauggacauugaggggagaccugaagauccaguagaaauugcccuauaucagccaaguucaggcuguuacauucacuucuuccgugaacccacugaccuaaaacaguucaagcaagaugcuaaguauucacacggaauugauguuacagaccuuuuugcugcacagccagguuugaccagugcuguuauagaggcacucccccgaaacauggucaugaccugucaggggucugaugacauaagaaagcuccuugagucacaaggaaggaaggauaucaaguugauugauauugcucucagcaagacagauucuagaaaauaugagaaugcagucugggaucaauacaaagauuuaugccacaugcauacagguguuguuguugaaaagaagaagaaggguggcaaagaggaaauaaccccucacugugcccuaauggacuguaucauguuugaugcagcagugucaggaggauugaacacaucaguucugagagcagugcuacccagagacaugguguuuagaacaucaacgcccaaagucguccuguaa

SEQ ID NO: 566 - RNA, 1710 nt, Artificial Sequence
  derived and/or modified CDS sequence (wt) from Lassa virus__AAT49007__NP
augagugucucaaaagagauaaaauccuuucuguggacacagucucugaggagggaguugucggguuacugcucuaacauaaaauuacaagugguuaaagaugcucaagcucuucugcaugggcuugacuucucugaggucagcaauguccagcgguugaugcgcaagcaaagaagggaugacaacgacuugaaacgacugagagaccuaaaccaggcaguuaacaaucuuguugagcugaaaucaacucaacaaaagaguguacugagaguugggacauuaacuucagaugacuuguugauuuuagcugcugaccuagagaagcugaagucaaaggugaccaggacagaaaggccauugagcgcugguauuuacauggguaaucuaagcucacaacaacuugaucaacgacgagcucuuuugaauaugauagggaugaguggcgggaaucaaggggcucagacugggagagacggaguggugaggauuugggaugugaaaaaugcagagcugcuuaacaaucaguuugggaccaugccaaguuugacacuggcuuguuuaacaaaacagggacagguugauuugaacgauguuguucaggcauugacagaccugggcuugaucuacacagcaaaguaucccaacaccucagaccuggauagacuaacccagagccacccuauucuaaacaugauugauaccaagaaaagcucucugaauaucucagguuauaacuucagcuuaggugcagcuguaaaagcaggagcuugcaugcuggaugguggcaacauguuagagacaaucaaagugucaccccaaacaauggaugguauucucaaguccaucuuaaaggucaagaaagcucuugggauguuuauuucagacacuccuggugagagaaacccuuaugagaacauacuuuacaagaucuguuugucgggggauggguggccauacauugcaucaaggacuucaauaacaggaagggcaugggaaaacacuguuguugauuuggaaucaggcgagaagccacaaaaaauugggagcaacaacuccaacaaauccuugcagucugcaggguucacugcugggcucaccuauucucagcucaugacucucaaggaugcaaugcugcagcuugauccaaaugcuaagaccuggauggacauugaggggagaccugaagauccaguagaaauugcucuauaucagccaaguucaggcuguuacauucacuucuuccgugaacccacugaccuaaaacaguucaaacaagaugcuaaguauucacacggaauugauguuacagaccuuuuugcugcacagccagguuugaccagugcuguuauagaggcacucccccgaaacauggucaugaccugucaggggucugaugacauaagaaagcuccuugaaucacaaggaaggaaggauaucaaguugaucgauauugcucucagcaagacagauucuagaaaguaugagaaugcagucugggaccaauacaaagacuuaugccacaugcauacagguguuguuguugaaaagaagaagaaggguggcaaagaggaaauaaccccucacugugcccuaauggacugcaucauguuugaugcagcagcgucaggaggauugaacacauuaguuuuaagagcagugcuaccuagagauaugguguuuagaacaucaacacccaaagucguccuguaa

SEQ ID NO: 567 - RNA, 1710 nt, Artificial Sequence
  derived and/or modified CDS sequence (wt) from Lassa virus__AAT49009__NP
augagugcuuccaaggaagugaaaucauuccuguggacucagucucugagaagagaacugucuggcuauugcuccaacauaaaguugcagguggugaaagaugcucaggcucuucuucauggccuggacuucucugaagucagcaauguucaacgcuugaugcguaaacagaggagagaugauggugaucuaaaacggcugagagaccuuaaucaggcagucaacaaucuuguugagcuaaagucaacucagcaaaaaaguguguugagaguugggacccugaacucagaugaucugcugguccuagcugcugaccuagaaaagcuaaagucaaaggucauuagaacagagagacccuugagcucaggaaucuacauggggaaucuaaguucacagcaacuugaucaaagaagggcucuucuaaacaugauuggcaugacugguggaaacagagggggggguaccuccagugauggcauugugagagucugggacgucaaaaaugcagagcuacucaacaaccaguuugggacaaugccaagucugacccuggcaugccugaccaaacaaggacaaguagaucugaaugaugcuguucaagccuuaacggacuuaggacuaaucuacacagcaaaguaccccaauucaucugaucucgauaggcuggcccagagucauccgauauugaauaugauugauacuaagaaaagcucacucaacaucucugguuacaacuuuagcuugggagcugcugucaaggcaggggccugcaugcuugaugguggcaauauguuggagaccauaaagguuucaccucagaccauagauggcaucuugaaaacaaucuugaaagucaagaagagucugggaauguucaucucagauguaccaggugagaggaacccuuaugagaauauacuguacaaaauuugucucucaggggauggauggccuuacauugcaucaaggacuucgauugugggaagagcaugggaaaauacugugguugaucuggaaucagacaacaaaccacaaaaaaccggaaauggagguucaaacaagucauugcagucugcagguuuugcugcaggguuaacuuacucccaauuaaugacccucaaagacucaaugcuucaacuugaccccaauucaaaaaccuggauggauauugaggggagaccagaggauccagucgagauagcucuguaucaaccaaacucaggcuguuacauacacuuuuuuagggaaccaacagacuuaaaacaauucaaacaggaugcaaaguauucacaugguauugaugugacagauuuguuugcugcacagccaggguugacaagugcagugauagaggcucuccccagaaacauggucaucaccugucaggggucagaggacaucagaaaacuucuggagucacaaggaagaagggauauaaagcugaucgacauuucccucaauaaagcggacucaaggaaauuugaaaaugcugugugggaucaguucaaggacuuaugccacaugcauacugggguuguuguggagaagaagaagagaggaggcaaagaggaaauaacuccucauugugcauugauggacugcauuauguuugaugcagcagucucgggagggcucgaugcaaagguccuaagagcugugcuccccagggacaugguauucagaaccucaacaccuaaagucguccuguaa

SEQ ID NO: 568 - RNA, 1710 nt, Artificial Sequence
  derived and/or modified CDS sequence (wt) from Lassa virus__ADI39452__NP
augaguguuucaaaagaggugaaauccuucuuauggacacaaucucugaggagggagcugucaggcuacugcuccaacaucaaauugcagguugugaaggaugcccaagcucuccugcauggacuugacuucucugagguaagcaauguccagcgucugaugcgcaaacaaaggagagaugauaaugauuugaagagacucagagaucugaaucaggcaguuaauaaucuuguugagcugaagucaacucaacaaaagagugucuuaagaguugggacccuaacuucagacgaucugcugauccuggcugccgaucuagagaaacugaagacaaaagucaccagaacagaaaggccacuaagugcaggugucuauauggggaaucugaguucacagcagcucgaacagagacgagcucucuuaaacaugauaggaaugaauggugguaaucaaggaguucaggcugggagagacggaguggugagagucugggauguaaagaacgcagagcuacuuaauaaccaguucgggacuaugccaagucugacgcuggcguguuugacgaagcaggggcagguugauuugaaugaugcgguucaggcacuuacagaccuugguuugauuuacacagcaaaguaccccaacaccucugacuuagacagauuggcucaaagccacccuauccugaauaugauugacaccaagaagagcucauugaacaucucggguuauaacuucagcuugggugccgcugugaaggcaggagccugcauguuggaugguggcaacaugcuagaaacaaucaaaguaucaccucaaacaauggaugguauucucaaaucuaucuugaaagugaaaaggacucuuggaauguuugucucagacacuccuggugaaagaaacccuuaugaaaacauacuuuacaaaauuugcuugucaggagauggauggccauacauugcaucgagaacaucaauaacaggaagagcuugggagaacaccauaguugauuuagaaucagacgggaaaccacagaagguugggaacaaugguuccaauaaaucuuuacaaucagcaggcuucacugcuggacucacauauucucaacucaugacucuuaaggaugcaaugcugcagcuugacccaaaugcaaagacuuggauggauauugagggaaggcccgaagauccuguagaaguugcucuuuaccaaccgagcucuggcugcuauauucacuucuuucgugagccuacugacuuaaagcaguucaaacaagaugccaaauauucucauggcauugaugucacagacuuguuugcugcacagccaggucugaccagugcaguuauagaagcacucccucgaaacauggucaucaccugccagggaucugaagauguaagaaagcuccuugaaucacagggaaggaaggacauaaaacugauugauauugcccucagcaaggcugacuccagaaaguaugaaaaugcagucugggaccaauacaaagaccugugucacaugcacacagguguuguuguugaaaagaagaaaagagguggcaaagaggagaugaccccucacugugcacugauggauugcaucauguuugaugcagcagugucgggaggauuaagcacacagguuuugagagcagugcugcccagagacauggucuuuagaacaucaacacccaaagucguccuguaa

SEQ ID NO: 569 - RNA, 1710 nt, Artificial Sequence
  derived and/or modified CDS sequence (wt) from Lassa virus__ADU56611__NP
augagugcuuccaaggaagugaaaucauuccuuuggacacagucauugaggagagagcuuucaggcuauugcucuaauauaaaacuccaaguggucaaggaugcucaggcccuucugcauggucucgacuucucugaggucagcaauguccagcgcuugaugcgcaaacagaaaagagaugacggugaccuaaaacgucuuagagaccuaaaucaggcaguuaacaaccuugucgagcucaagucaacacaacaaaagaguguucugaggguuggaacauugaccucagacgacuugcugacuuuagcagcugaucuagagaaauugaagucaaagguuauuaggacggagagaccauuaaguucagguguguauauggggaacuugagcacacaacaacuugagcagaggaaggcguuguugaguaugauaggcauggucgguggugcucagggaacccaaccuggaagagacggaguugucagagugugggaugucaaaaacccggaccuccucaacaaccaauuuggcaccaugccuaguuuaacgcuagcaugucucacuaaacagggucagguugacuuaaaugacgccguucuggcgcuaacagacuugggauuaauauacacagcuaaauaccccaauaguuccgaccuagacagacuuucccagagccauccuauacugaauaugguagauaccaagaagagcucccuaaauauuucugguuauaauuuuaguuugggagcugcagugaaggccggagcuugcaugcucgauggggguaacauguuggaaacuaucaaggugacgccucagacaauggauggcauucugaagucuauucuaaagguaaaaaggucccugggaauguuuguuucagacacaccuggugaaagaaacccuuaugaaaacauacuuuacaaaauuugucucucuggggacggcuggcccuacauagcuucaagaaccuccauuguggguagagcuugggagaauaccacuguagaccuugagucagaugggaaaccacagaaaguggguacugcuggauccaacaaaucucugcaaucugcuggguucccaacagggcugaccuauucucaacugaugacacucaaagauucaaugaugcaacuugacccaagcgccaaaaccuggauagacauugaaggucguccagaagacccuguugagauagcucuuuaccaaccuaugucaggcuguuauauacauuucuucagagaaccaacggauuuaaaacaguucaaacaagaugccaaauauucucaugggauugaugugacagaucucuuuucugcucagccuggucuaaccagugcagucauugaggcucucccccgcaacaugguguugacgugccaagguucagacgacauuaaaaaacucuuggauucucaggggagaagggacaucaagcucauugacaucucauuaaauaaggcugauucuaggagauuugaaaaugcugucugggaucaguguaaagauuugugucacaugcacacuggagugguuguugagaaaaagaagagaggaggcaaagaggagaucacuccacauugugcuuuaauggauugcauaauguuugacgcagcugugucaggaggacucaauauaccaaucuugagagcuguucucccaagagauaugguguucagaacuucaagucccaaagucguccuguaa

SEQ ID NO: 570 - RNA, 1710 nt, Artificial Sequence
  derived and/or modified CDS sequence (wt) from Lassa virus__ADU56615__NP
augagugccuccaaggaagugaaaucauuccuauggacucagucucugagaagagagcuaucuggcuauugcucuaauauaaaacuccagguggugaaggaugcucaagcucuccuucauggcuuagacuucucugaggucaguaauguucagcgcuugaugcgcaaacaaaaaagagaugauagugaucucaaacggcuaagagaccucaaucaagcagucaacaaccuuguugagcuaaagucaacucaacagaaaaguguuuugagaauuggaacccuaaguucagaugaucuauugauuuuagcugcugaccuagaaaaacugaaaucaaagguuguuaggacagaaagaccccugagcucaggaaucuacauggggaauuuaaguucacagcagcuugaucagaggaaagcccuccuuaacaugaucggcaugacuggugggaauggggggaggaaugccacuagugauggcauugugagaguuugggaugucaaaaaugcggagcugcucaacaaucaguuuggaacaaugccaagucugacucuagcaugucugacuaaacaagggcaaguggauuugaaugaugcuguucaggccuugacagacuugggguuaauuuacacagcaaaauacccuaacucaucugaucuggacaggcuggcccagagccauccaauauugaauaugauugacaccaagaagagcucccuuaacaucucugguuacaacuuuagcuuaggagcugcugucaaggcaggggcuugcaugcuugauggaggcaacauguuggagacuauaaaggucucaccucaaaccauggauggcaucuugaagucaauccugaaagucaagagaagccugggaauguucaucucagacacaccaggugagaggaacccuuaugaaaacauacuguacaaaaucugccucucaggagauggguggccuuacauugcaucaaggacuucaauuguggggagagcuugggaaaacacugugguugacuuagagacagauaacaaaccacaaaagaccgggaauggggguucaaauaagucacugcaaucugcaggguuugcugcaggacugacuuacucucaauuaaugaccuuaaaggauucaaugcuucagcuugacccaaacgcaaagaccuggauggauauugagggaagaccagaagauccaguugaaauagcucuguaucaaccaguuucaggcuguuauauacacuucuuuagggaaccaacagacuugaagcaguuuaaacaggaugcaaaauauucacaugguauugauguaacggauuuguuugcugcacagccaggguugacaagugcagugauagaggcucuuccuaggaacauggucaucaccugucaaggaucagaagacaucaggaaacuucuggagucacaggggagaagagauauaaagcugauugacauuucccucaguaagguggauucaagaaaauuugagaacgcugugugggaccaguucaaagaccuaugucacaugcacaccgggauuguuguggagaagaaaaagagaggaggcaaggaggaaauaacuccucauugugcauugauggacugcaucauguuugaugccgcagucucaggaggaguugaugcaaagguccugagggcuguacucccuagagacaugguguucaggacuucgacaccuaaagucguccuguaa

SEQ ID NO: 571 - RNA, 1710 nt, Artificial Sequence
  derived and/or modified CDS sequence (wt) from Lassa virus__ADU56619__NP
augagugcuuccaaagaagugaaaucauuccuguggacucagucucugagaagagaguuaucuggcuauugcuccaauauaaaacuccaggugguaaaggaugcucaagcucuccuucaugguuuggacuucucugaggucaguaauguucaacgcuugaugcgcaaacaaaaaagggacgauggugaucuuaaacggcuaagagaccucaaucaagcagucaacaaccuuguugaacuaaagucaacucaacaaaagagugugcugaggguuggaacccuaaguucagacgaucuauugguuuuggcugcugaccuggaaaaacugaagucaaagguuguuaggacagaaagaccccugagcucaggaauuuauauggggaaucuaaguucacagcagcuugaucagaggaaggcccuccucaacaugauuggcaugacuggugggaaugggggaaggaauaccacuagugaugguauugugagaguuugggacgucaagaaugcagagcugcuuaacaaucaguuugggacaaugccaagucuaacucuagcauguuugaccaaacaagggcaaguggauuugaaugaugcuguucaggcuuugacagauuugggauugauuuacaccgcaaaauacccuaauucaucugauuuggacaggcuggcccagagccauccgauauugaacaugauugauacuaagaagagcucccuuaacaucucugguuacaauuuuaguuuaggagccgccgucaaggcuggggccugcaugcuugauggaggcaauaugcuagagacuauaaaggucucaccucaaaccauggauggcaucuugaagucaaucuugaaagucaagagaagccugggaauguucaucucagauacgccaggugaaaggaacccuuaugaaaacauacuguacaaaaucugccucucaggagauggguggccuuacauugcaucaaggacuucaauugugggaagagcuugggagaacaccgugguugacuuagagucagacaacaaaccgcaaaagaccggcaauggggguucaaauaagucauugcaaucugcaggguuugcugcaggacugacuuauucucaacugaugaccuuaaaggauucaaugcuucagcuugacccaaaugcaaagacuuggauggauauugagggaagaccagaagauccaguugaaauagcucuguaucaaccaaguucaggcugcuauauacacuucuucagggaaccgacagacuuaaagcaguuuaaacaggaugcaaaauauucacaugguauugaugugacagauuuguuugcugcacagccaggguuaacaagugcagugauagaggcucuuccuagaaacauggucaucaccugucaagggucagaagacaucagaaaacuucuggagucacaggggaggagggauauaaaacugauugacauuucccuuaguaagguggacucaagaaaauuugagaaugcugugugggaucaauucaaggauuuaugucacaugcacaccgggauuguuguggagaagaaaaagaggggaggcaaggaggaaauaacaccucauugugcauuaauggacugcaucauguuugaugcugcagucucaggaggaguugaugcaaagguccugagggcugugcuccccagagauaugguguucagaacuucgacacccaaagucguccuguaa

SEQ ID NO: 572 - RNA, 1710 nt, Artificial Sequence
  derived and/or modified CDS sequence (wt) from Lassa virus__ADU56623__NP
augagugcuucuaaggaagugaagucauuucucuggacacagucuuugaggagggagcuuucagguuauugcuccaauauaaaacuucaaguuguuaaggaugcucaggcucuccuucauggucuugacuuuucugaagucagcaaugugcagcgcuuaaugcgcaaacaaaagagggaugauagugaucuaaaacgucucagagauuugaaucaggcugucaacaaucuuguagaacucaaaucgacacagcaaaagaguaucuugagaguugggaccuugaccucagaugaccugcugacauuggcagcugacuuagagaaacuaaagucgaaggucauuagaacagaaaggccacuaagcucagguguuuauauggggaauuugaguacacagcagcuugagcagaggagagcauugcugaacuugauagguaugguugguggggcucagggcacccaaccuggaagagacggaguuguuaggguuugggauguuaagaauccggaccuuuugaacaaccaguucggcaccaugccuagucugacauuggcaugucucaccaaacaaggucaaguugauuugaaugaugccgucuuagcacugacagaccugggccuaauauacacagccaaguacccaaauagcuccgaccuggacagacuuucccaaagccauccuauacugaauaugguggacacuaagaagagcuccuugaacauuucugguuucaacuucagcuuaggagcugcagugaaagcuggagccuguaugcuugauggggggaacauguuggagaccaucaagguuacaccucagacaauggauggcaucuugaagucuauuuuaaagguaaaaaaaucuuugggaauguuuguuucggacacaccuggugagaggaacccuuaugagaauauacuuuacaagaucugucuuuccggugacggauggcccuacauagcuucaaggacuucuauuguagguagggcuugggagaauaccacuguggaucucgagucagauggaaaaccgcauaaagugggcacugcugggucaaacaagucuuugcagucagcgggguucccaacagggcugacuuauucucaguugaugacacucaaagacucaaugaugcagcuugacccgagugccaaaaccuggauagacauugaaggucguccagaagacccuguggagauagcccuuuaccaaccuaugucaggcuguuacauacacuucuucagagaaccaacagacuugaaacaguucaagcaagaugccaaauauucucaugggauugauguggcagaucuuuucccugcucaaccugguuugaccagcgcagucauugaggcccucccucgcaauauggugcuaaccugucaagguucagaugauauuaagagacucuuagauucccaaggaagaagggauauaaagcuuauugacauugcacugagcaaggcugacucuaggagauuugaaaaugcuguuugggaucagugcaaagaucuaugccauaugcacacuggagugguugucgaaaagaagaaaagaggaggcaaagaagaaaucaccccgcacugugcuuuaauggacugcauaauguaugaugcagcugugucaggaggacucaauauaccaguuuuaagggcaguucuccccagggauaugguguuuagaaccucaagucccaaggucguccuguaa

SEQ ID NO: 573 - RNA, 1710 nt, Artificial Sequence
  derived and/or modified CDS sequence (wt) from Lassa virus__ADU56627__NP
augagcgcuucuaaggaagugaagucauuucucuggacacagucauugaggagggagcuuucagguuauugcuccaacauaaaacuucaaguuguuaaggaugcucaggcucuccuccauggucuugacuuuucugaaguuagcaaugugcagcgcuugaugcgcaaacagaaaagggacgauagugaucugaaacgucucagagauuugaaucaggcugucaacaaucuuguagaacucaaaucgacacaacaaaagaguaucuugagaguugggaccuugaccucagaugaccugcugacauuggcagcugacuuagagaagcuaaagucgaaggucauuagaacagaaaggccacuaagcucagguguuuauauggggaauuugaacacacagcagcuugagcagagaagagcauugcugaacaugauaggcauggcugguggggcucaaggcacccaaccaggaagagacggaguuguuagggugugggauguuaagaauccggaucuuuugaacaaccaguuuggcaccaugccuagucugacauuagcaugucucaccaaacaaggucaaguugauuugaaugaugccgucuuagcacuaacagacuugggucuaauauacacagcuaaguacccaaauagcuccgaccuggauagacuuucccaaagccauccuauacuaaauaugguggacacuaagaaaagcuccuugaacaucucugguuacaacuucagcuuaggagcugcagugaaagcuggggcuuguaugcuugauggagggaacauguuggagaccaucaagguuacaccucagacaauggauggcaucuugaaguccauuuuaaagguaaaaaaaucuuugggaauguuuguuucagauacaccuggugagaggaacccuuaugagaacauacuuuacaagaucugucuuucaggugacggcuggccuuacauagcuucaaggacuucuauuguggguagagcuugggagaauacuacuguggaucucgagucagauggaaagccgcaaaaagugggcacugcuggguccaacaagucuuugcagucagcgggguucccaacagggcugacuuauucucaguugaugacacuuaaagacucaaugaugcagcuugacccaagugccaagaccuggauagacauugaaggucguccagaagacccuguggaaauagcucuuuaccaaccuaugucgggcuguuacauacacuucuucagagaaccaacagacuuaaaacaauucaagcaagaugccaaauauucucaugggauugauguggcagaucuuuucccugcucaaccugguuugaccagcgcagucauugaagcccucccucgcaauauggugcugaccugucaagguucagaugacauuaagagacucuuggauucccaaggaagaagggacauaaagcuuauugacauugcacugagcaaggcugacucuaggagauuugaaaaugcuguuugggaucagugcaaagaccuaugccauaugcauacuggagugguugucgaaaagaagaaaagaggaggcaaagaagaaauaaccccgcauugugcuuuaauggauugcauaauguaugaugcagcugugucaggaggacucaauauaccaguuuugagagcaguucuccccagggacaugguguuuagaaccucaagccccaaggucguccuguaa

SEQ ID NO: 574 - RNA, 1710 nt, Artificial Sequence
  derived and/or modified CDS sequence (wt) from Lassa virus__ADU56631__NP
augagugcuuccaaggaagugaagucauuucucuggacacagucauugaggagggagcuuucagguuacugcuccaauauaaagcuucaaguugucaaggaugcucaggcucuccuucauggccuugacuuuucugaaguuagcaaugugcagcgcuugaugcgcaaacaaaaaagagaugauagugaucugaaacgccucagagaucugaaucaggcugucaacaaucuuguagaacuuaaaucaacacaacaaaagaguaucuugagaguugggaccuugaccucagaugaccugcugacauuggcagcugacuuagagaagcuaaagucgaaggucaucagaacagaaaggccacuaagcucagguguuuauauggggaauuugagcacacagcagcuugagcaaagaagagcauugcugaacaugauaggcaugguugguggagcucagggcacccaaccuggaagagacggaguuguuagggugugggauguuaagaauccagaucuuuugaauaaccaguucggcaccaugcccagucugacauuagcaugucucacuaaacaaggucaaguugauuuaaaugaugccgucuuagcacuaacagaccugggucuaauauacacagcuaaguacccuaacaguuccgacuuggacagacuuucucaaagccauccuauauugaacaugguggacacuaagaagagcuccuugaacauuucugguuacaacuuuagcuuaggagcugcagugaaagcuggagcuuguaugcuugauggggggaacauguuggagaccaucaagguuacaccucagacaauggauggcaucuugaagucuauuuuaaagguaaaaaaauccuuaggaauguuuguuucagauacaccuggugagaggaacccuuaugagaacauacuuuacaagaucugucuuuccggugacggcuggcccuacauagccucaaggacuuccauuguggguagagcuugggagaauacuacuguagaucucgagucagauggaaaaccacaaaaggugggaacugcuggguccaacaagucuuugcagucagcgggguuuccaacagggcugacuuauucucaguugaugacacuuaaagacucaaugaugcagcuugauccaagugccaaaaccuggauagacauugaaggucguccagaagacccuguggaaauagcucuuuaccaaccuaugucgggcugcuauauacauuucuucagagaaccaacagacuuaaaacaguucaagcaagaugccaaauauucucaugggauugauguaacagaucuuuucccugcucaaccuggauugaccagugcagucauugaggcccucccucgcaauaugguacugaccugucaggguucagaugauauuaagcgacucuuggauucccaaggaaggagagacauaaagcucauugacauugcacugagcaaggcugacucuaggagauuugaaaaugcuguuugggaucagugcaaagaucuaugccauaugcacacuggagugguugucgaaaagaagaaaaggggaggcaaagaagaaauuaccccacacugugcucugauggacugcauaauguaugaugcagcugugucaggaggacucaauauaccaguuuuaagagcaguccuccccagagacaugguguuuagaaccucaagccccaaagucguccuguaa

SEQ ID NO: 575 - RNA, 1710 nt, Artificial Sequence
  derived and/or modified CDS sequence (wt) from Lassa virus__AFY05580__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagggaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaggucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaaugcagaguugcucaguaaucaguucgggaccauaccaagucugacacuggcaugucugacaaaacaggggcagguugacuugaaugaugcaguacaagcauugacagauuuggguuugaucuacacagcaaaguaucccaacacuucagacuuagacaggcugacucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucaggugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 576 - RNA, 1710 nt, Artificial Sequence
  derived and/or modified CDS sequence (wt) from Lassa virus__AFY05581__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagggaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaagucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaaugcagaguugcucaguaaucaguucgggaccauaccaagucugacacuggcaugucugacaaaacaggggcagguugacuugaaugaugcaguacaagcauugacagauuuggguuugaucuacacagcaaaguaucccaacacuucagacuuagacaggcugacucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucaggugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugaaagcagugcugcccagagauaugguguucagaacaucgacaccuagagucguucuguaa

SEQ ID NO: 577 - RNA, 1710 nt, Artificial Sequence
  derived and/or modified CDS sequence (wt) from Lassa virus__AFY05587__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagggaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaggucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaaugcagaguugcucaguaaucaguucgggaccaugccaagucugacacuggcaugucugacaaaacaggggcagguugacuugaaugaugcaguacaagcauugacagauuuggguuugaucuacacagcaaaguaucccaacacuucagacuuagacaggcugacucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuugggauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucagaugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 578 - RNA, 1710 nt, Artificial Sequence
  derived and/or modified CDS sequence (wt) from Lassa virus__AFY05591__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagagaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaagucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaauguagaguugcucaguaaucaguucgggaccaugccaagucugacacuggcaugucugacaaaacaggggcagguugacuugaaugaugcaguacaagcauugacagauuuggguuugaucuacacagcaaaguaucccaacacuucagacuuagacaggcuggcucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacuguuguugaucuggaaucagaugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 579 - RNA, 1710 nt, Artificial Sequence
  derived and/or modified CDS sequence (wt) from Lassa virus__AFY05597__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagggaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaagucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaaugcagaguugcucaguaaucaguucgggaccaugccaagucugacacuggcaugucugacaaaacaggggcagguugacuugaaugaugcaguacaagcauugacagauuuggguuugaucuacacagcaaaguaucccaacacuucagacuuagacaggcugacucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucagaugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 580 - RNA, 1710 nt, Artificial Sequence
  derived and/or modified CDS sequence (wt) from Lassa virus__AFY05610__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagggaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaagucaaaggugaucagaacagaaaggccauuaagugcaggugucuauaugggcaaccugagcucacagcaacuugaccaaagaagagcucuccugaauaugauaggaaugaguggugguaaucaaggggcucgggcugggagagauggaguggugagaguuugggaugugaaaaaugcagaguugcucaguaaucaguucgggaccaugccaagucugacacuggcaugucugacaaaacaggggcagguugacuugaaugaugcaguacaagcauugacagauuuggguuugaucuacacagcaaaguaucccaacacuucagacuuagacaggcugacucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucagaugggaagccacagaaagcugacagcaacaauuccaguaaaucccugcagucggcaggguuuaccgcugggcuuaccuauucucagcugaugacccucaaggaugcaaugcugcaacuugacccaaauacuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 581 - RNA, 1710 nt, Artificial Sequence
  derived and/or modified CDS sequence (wt) from Lassa virus__AFY05616__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagagaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaagucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaaugcagaguugcucaguaaucaguucgggaccaugccaagucugacacuggcaugucugacaaaacaggggcagguugacuugaaugaugcaguacaagcauugacagauuuggguuugaucuacacagcaaaguaucccaacacuucagacuuagacaggcuggcucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucagaugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 582 - RNA, 1716 nt, Artificial Sequence
  derived and/or modified CDS sequence (wt) from Lassa virus__AFY05618__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagggaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaggucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaaugcagaguugcucaguaaucaguucgggaccaugccaagucugacacuggcaugucugacaaaacaggggcagguugacuugaaugaugcaguacaagcauugacagauuuggguuugaucuacacagcaaaguaucccaacacuucagacuuagacaggcugacucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucagaugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 583 - RNA, 1710 nt, Artificial Sequence
  derived and/or modified CDS sequence (wt) from Lassa virus__AHC95552__NP
augagugcuucuaaagaagugaaaucuuuccuauggacacagucuuugaggagagaauuaucgggcuacuguuccaacaucaagcugcagguggugaaggaugcccaagcucuucuacauggacuugauuuuucagaggucagcaauguccaacggcugaugcgcaagcagaggagggaugauggugaucuaaaacgacucagggaccuaaaccaggcagucaacaaccuuguugaguugaaaucaacacaacagaaaaauguacugagaguugggacccugaacucagaugacuuauugaccuuagcagcugauuuagagaagcugaagucuaaagucacaagaacagagaggccccugagcucaggugucuacaugggaaaccugaguucacagcagcuugaucagaggagggcacuccuaaauaugauagggaugacggguggcaaucaagggacccaagcugggagagaugggguggugagagucugggauguaaaaaaugcagaauuauugaauaaucaauuugguacaaugccaagcuugacauuagcaugucuaacaaaacaagggcaagcugauuuaaaugaugugguccaagcacucacagauuugggcuugauuuacacagcuaaauauccuaaugccucugaucuggacagguugacucaaagucaccccauuuuaaacaugauugauaccaagaagagcucccugaacaucucagguuauaacuuuaguuugggugcugcaguaaaagcaggugccuguauguuggauggugggaacauguuggaaacaaucaaaguuucaccucaaucaauggauggcauuuuaaaguccaucuugaaggucaagagagcucuugggauguuuguuucagacacuccgggugaaaggaacccuuaugaaaacauacucuauaaaauuugcuuaucaggugauggguggccauacauugcaucuagaacaucaauaguagggagggccugggaaaacacugugguagaccucgaggcagacggaaacccaaaaaaacucaacagcaauggcuccaauaaaucucuccagucugcaggcuucccagcugggcugaccuacucucaacuuaugacucuuaaagaugcaaugcugcagcuugacccaaaugccaagacauggauggacauagaggggagaccagaggacccgguggaaguugcccucuaucagcccaacucugggugcuauauacacuucuuucgggagcccacugaucuuaagcaguuuaaacaagaugcaaaguauucucauggaauugaugucacagauuuguuugcugcacaaccuggucugaccagugcuguuauugaggcacuuccucggaauaugguuaucacuugccaggggucugaagacauaaggaagcuucuugaaucacaagggagaaaagacauaaaacugauugacauugcccuuaguaagacugacuccagaaaguuugagaaugcugugugggaucaauacaaggaucugugucacaugcacacagguguugucguugagaagaagaagagagguggcaaggaagaaauuaccccucauugugcacuaauggacugcaucauguuugaugcugcugucucagggggacuaaauacauugguccucagggcuguucugcccagagacaugguguuuagaacaucaacaccaagagucgucuuguaa

SEQ ID NO: 584 - RNA, 1710 nt, Artificial Sequence
  derived and/or modified CDS sequence (wt) from Lassa virus__AHC95554__NP
augagugccucuaaggaagugagguccuucuuauggacacagucuuuaaggagagaguugucaggcuauugcuccaacauuaaacuucagguggugaaggaugcucaagcccuucuacaugggcuugauuucuccgaggucagcaauguucagcgacugaugcgcaaacaaagaagagaugauggugaucugaagcgacuuagagaccugaaucaggcagucaauaaucuuguugaauuaaaaucaacacaacagaaaagugugcuaaggguuggcaccuugaacucggaugaucuguugacuuuggcggcugaucuugagaaacugaaaucaaaggucacaagaacagagagaccuuugagcucaggcgucuacaugggaaacuuaagcucacaacagcuugaucagaggagggcacuccuaaacaugauaggaaugacagguggcaaucaaggggcccaggcugggagggauggaguggugagaguuugggaugugaaaaaugcggaguuguuaaacaaccaauuugggacaaugccgaguuugacacuagcaugucuaacaaaacaggggcaagucgaccugaaugaugugguucaagcacucacagaucuggguuugauuuauacugccaaauaccccaauacuucagacuuagauagguugacccagagucaccccauucugaauaugauugacaccaagaagagcucccugaacaucucagguuacaauuucagucugggugcugcagugaaagcaggugccuguauguuggaugguggcaacaugcuagaaacaaucaaaauuucaccucaaucuguggauggcauuuugaaauccaucuugaagguuaagaggucucuuggaauguucguuucagacaccccgggugaaagaaaccccuaugaaaacauacucuauaaaaucugccugucaggugauggguggccauacauugcauccagaacaucaauagugggaagggccugggaaaacacugugguggacuuagaagcagaugggaaaccacaaaaaccaaacagugguagcucaaauaaaucccuccaaucugcaggcuuuccagcuggguugaccuacucucaacucaugacucucaaagaugcaauguugcaacuugauccaaaugccaagacauggauggauauagaggggaggccggaagacccgguggaaguugcccuauaucagccuagcucuggguguuacauacacuucuuccgagagcccacugaucuuaaacaauucaaacaagaugcaaaguacucccauggaauugaugucacagaucuguuugcugcacaaccagguuugaccagugcuguuauugaggcacucccccgaaauaugguuaucaccugccaagggucugaagacauaaagaagcuucuugaaucacaaggaagaaaggacauaaaauugauugacauugcccuuagcaaaauugacucuaggaaauuugaaaaugcuguaugggaucaauacaaagauuugugucacaugcacacagguguuguuguugaaaagaagaagagagguggcaaggaagaaauuaccccucauugugcgcuaauggauugcaucauguucgaugcugcugugucaggaggacuaaaugcaucgguucucagggcuguauugcccagggacaugguguuuagaacaucaacaccaaaagucguccuguaa

SEQ ID NO: 585 - RNA, 1710 nt, Artificial Sequence
  derived and/or modified CDS sequence (wt) from Lassa virus__AHC95556__NP
augagugccucuaaagaaguuaaaucuuuccuauggacacagucuuugaggagagaauuaucgggcuacuguuccaacaucaaguugcagguggugaaggaugcccaagcucuucuacauggacuugauuuuucagaggucagcaauguccaacgguugaugcgcaagcagaggagggaugauggugaucuaaagcgacucagggaccuaaaccaggcagucaacaaucuuguugaguugaaaucaacacaacagaaaaaugugcugagaguugggacccugaacucagaugacuuauugaccuuagcagcugauuuagagaagcugaagucuaaagucacaagaacagagaggcccuugagcucaggugucuacaugggaaaccugaguucacagcagcuugaucagaggagggcacuccuaaauaugauagggaugacggguggcaaucaagggacccaaacugggagagaugggguggugagagucugggauguaaaaaaugcagaauuguugaauaaucaguuugguacaaugccaaguuugacauuagcaugucuaacaaaacaagggcaagcugauuuaaaugaugugguccaagcacucacagaucugggcuugauuuacacagcuaaauauccuaaugccucugaucuggauagguugacucaaagucaccccauuuuaaacaugauugauaccaagaagagcucccugaacaucucagguuauaacuuuaguuugggugcugcaguaaaagcaggugccuguauguuggauggugggaacauguuggaaacaaucaaaguuucaccucaaucaauggauggcauuuuaaaguccaucuugaaggucaagagagcucuugggauguuuguuucagacacuccgggugaaaggaacccuuaugaaaacauacucuauaaaauuugcuuaucaggugauggguggccauacauugcaucuagaacaucaauaguagggagggccugggaaaacacugugguagaccucgaggcagacggaaacccaaaaaaacucaacagcaauggcuccaauaaaucucuccagucugcaggcuucccagcugggcugaccuacucucaacuuaugacucuuaaagaugcaaugcugcaacuugacccaaaugccaagacauggauggacauagaggggagaccagaggacccgguggaaguugcccucuaucagcccaacucuggaugcuauauacauuucuuucgggagcccacugaucuuaagcaguuuaaacaagaugcaaaguauucucauggaauugaugucacagauuuguuugcugcacaaccuggucugaccagugcuguuauugaggcacuuccucggaauaugguuaucacuugccaggggucugaagacauaaggaagcuucuugaaucacaagggagaaaagacauaaaacugauugacauugcccuuaguaagacugacuccagaaaguuugagaaugcugugugggaucaacacaaggauuugugucacaugcacacagguguuguuguugagaagaagaagagagguggcaaggaagaaauuaccccucacugugcacuaauggacugcaucauguuugaugcugcugucucagggggacuaaauacauugguccucagggcuguucugcccagagacaugguguuuaggacaucaacaccaaaagucguccuguaa

SEQ ID NO: 586 - RNA, 1710 nt, Artificial Sequence
  derived and/or modified CDS sequence (wt) from Lassa virus__AHC95558__NP
augagugccuccaaagaaguaagguccuuccuauggacacagucuuuaaggagagagcugucagguuacugcuccaauaucaagcuucagguagugaaggaugcccaagcucuuuugcaugggcuugauuucuccgaagucagcaauguccaacgguugaugcgcaaacaaaggagagaugauagugaucugaagcgacuuagagaccugaaucaggcagucaauaaccuuguugaauuaaagucaacacagcaaaaaagugugcugaggguugguaccuugaguucagacgaccuguugacucuggcagcugaucuugaaaagcugaagucgaaggucauaagaacagaaaggccuuugaguucaggugucuacaugggaaaccuaagcucacaacagcuugaucagagaagggcacuucugaauaugauagggaugacagguggcaaucagggggcccaggcugggagggauggaguagugagagucugggaugugagaaaugcagaauugcugaacaaccaauuugggacaaugccaaguuuaacauuagcaugucuaacaaagcaggggcaaguugaccugaaugaugugguucaagcacucacagaucuggguuugauuuacacagccaaauaucccaacacuucagauuuagauagguugacccagaaucaccccauuuugaauaugauugacaccaagaagagcucuuugaacaucucaggcuacaauuucagucugggugcugcagugaaagcaggugccuguaugcuggaugguggcaacauguuagaaacaaucaaaguuucaccucaaucuauagauggcauuuuaaaauccauucuaaaggucaagagaacucuuggaauguuuguuucagacaccccaggugaaagaaaccccuaugaaaacauacucuauaaaaucugcuugucaggugauggauggccauacauugcaucuagaacaucaauaguaggaagggcuugggaaaacacugugguggaccuagagacagacaggaaaucacaagggcccaacaguggcaacucaaacaaaucccuccaaucugcaggcuuuucagcuggacugacuuacucucagcuuaugacucucaaagacgcaauguuacaacuugauccgaaugccaagacauggauggacauagaagggaggccggaagacccaguggaaguugcccuauaucaacccaucuccggguguuacauacauuucuuccgagaacccacugaucucaaacaauucaaacaagaugcaaaguacucucauggaauugauaucacagaucuauuugcugcacagccagguuugaccagugcuguuauugaggcacucccucggaauaugguuaucaccugccaagggucugaggacauaaagaagcuccuugaaucacaaggaagaaaggauauaaaacugauugacauugcccuuagcaagauugauucuaggaaguuugaaaaugcuguaugggaucaauacaaagauuugugucacaugcacacagguguuguugucgagaagaagaagagaggugguaaggaagaaauuaccccucauugugcacuaauggauugcaucauguuugaugcugcugugucaggaggacuaaaugcaucgguucucagggccguguuacccagagacaugguguuuagaacaucaacaccaaaagucguccuguaa

SEQ ID NO: 587 - RNA, 1710 nt, Artificial Sequence
  derived and/or modified CDS sequence (wt) from Lassa virus__AHC95560__NP
augagugccucuaaggaagugaaaucuuuccuauggacacagucuuugaggagagaauuaucgggcuacuguuccaacaucaaacugcagguaguaaaggaugcccaagcucuucuacauggacuugauuucucagaggucagcaauguccaacgguugaugcguaagcagaggagggaugauggugaucuaaagcgacucagggaccuaaaccaggcagucaacaaucuuguugaguugaaaucaacacaacagaaaaaugugcugagaguugggacccugaacucagaugacuuauugaccuuagcagcugauuuagagaagcugaagucuaaagucacaagaacagagagacccuugagcucaggugucuacaugggaaaccugaguucacagcagcuugaucagaggagggcacuccuaaacaugauagggaugucggguggcaaucaagggacccaaguugggagagaugggguggugagggucugggaugugaaaaaugcagaauuguugaacaaucaguuugguacaaugccgaguuugacauuagcaugucuaacaaaacaggggcaagcugauuuaaaugaugugguccaagcacucacagaucuggguuugauuuacacagccaaauauccuaaugccucugaucuagacagguugacccaaagucaccccaucuuaaacaugauugacaccaagaagagcucccugaacauuucagguuauaacuuuaguuugggcgcugcaguaaaagcaggugccuguauguuagauggugggaacauguuggaaacaaucaaaguuucaccucaaucaauggauggcauuuuaaaauccaucuugaaagucaagagagcucuuggaauguuugucucagacacuccgggugaaaggaacccuuaugaaaacauacucuauaaaauuugcuuaucaggugauggguggccauacauugcaucuagaacaucaauaguagggagagccugggaaaacacugugguagaccuugaagcagauggaaacccaaaaaaacucaacagcaauggcuccaauaaaucucuccagucugcaggcuuuccagcugggcugaccuacucucaacuuaugacucuuaaagaugcaaugcugcaacuugacccaaaugccaagacauggauggacauagaggggagaccagaggauccgguggaaguugcccucuaucagcccaacucugggugcuauauacacuucuuucgggagcccacugaucuuaagcaguuuaaacaagaugcgaaguauucucaugggauugaugucacagauuuguuugcugcacaaccuggucugaccagugcuguuauugaggcacuuccucggaauaugguuaucacaugccaggggucugaagacauaaggaagcuucuugaaucacaagggagaaaagacauaaaacugauugacauugcccuuaguaagacugacuccagaaaauuugagaaugcugugugggaucaacacaaggaucugugucacaugcacacagguguugucguugagaagaagaagagagguggcaaggaagaaaucaccccucauugugcacuaauggacugcaucauguuugaugcugcugucucagggggucuaaacacauugguccuuagggcuguucugcccagagacaugguguucagaacaucaacaccaaaagucguccuguaa

SEQ ID NO: 588 - RNA, 1710 nt, Artificial Sequence
  derived and/or modified CDS sequence (wt) from Lassa virus__AIT17127__NP
augagugccucaaaggaaauaaaguccuuucuguggacacaaucauugaggagggaauugucugguuacugcuccaacaucaaacuacaggugguaaaagaugcccaggcucuucugcauggucuugacuucuccgaagucaguaauguucaacgguuaaugcgcaaggagagaagggaugacaaugacuugaaacgguugagggaccuaaaucaagcggucaacaaccuuguugaguuaaaaucaacucaacaaaagaguauacugagaguugggacucuaaccucagaugacuuauuaaucuuagcugcugaucuagagaaguugaaaucaaaggugaucaggacagaaaggccauugagugcaggugucuauaugggcaacuugagcucacagcaacuugaccaaagacgggcucuucugaguaugauaggaaugaguggugguaaucaagggguucgggcugggaaggauggaguggugagaguuugggaugugaaaaaugcagaguugcuuaauaaucaguuugggacuaugccaagucuaacacuggcaugucugacaaaacaggggcagguugacuugaaugaugcagugcaagcacugacagauuugggucugaucuacacagcaaaguaucccaauacuucagacuuagauaggcugacucaaagucaccccaucuuaaacaugauugacaccaagaagaguuccuugaauaucucugguuauaauuuuagcuugggugcagcugugaaagcaggagcuugcaugcuggaugguggcaauauguuggagacaaucaaagugucaccucagacaauggaugguauccucaaauccaucuuaaaggucaagaaggcucuugggauguucaucucagacaccccuggugaaaggaauccuuaugaaaacauacucuacaagauuuguuugucaggagauggauggccauauauugcaucaagaacuucaauaacaggaagagccugggaaaacacugucguugaccuagaaucagaugggaagccacagaaagcuggcagcaacaauuccaauaaaucccugcagucggcaggguuuaccgcugggcuuaccuauucucagcugaugacccucaaggaugcgaugcugcagcuugacccaaacacuaagacuuggauggacaucgaaggaagaccugaagacccaguggaaauugcccucuaucagccaaguucaggcugcuacauacacuuuuuccgugaaccuacugauuuaaagcaguucaagcaggaugcuaaguacucacaugggauugauguuacagaccucuucgcugcacaaccgggcuugaccagugcugucauagaugcacucccccggaauauggucauuaccugucagggguccgaugacauaaggaaacuccuugaaucacaagguagaaaagacaucaaacuaauugauauugcccucaacaaaacugauuccaggaaguaugaaaaugcagucugggaucaguauaaggacuugugccacaugcacacaggugucguuguugaaaagaagaaaagaggcgguaaagaggaaauaaccccucacugugcacuaauggacugcaucauguuugaugcagcagugucaggaggacugaacacaucuguuuugagagcagugcugccuagagauaugguauucagaacaucaacacccagagucguccuguaa

SEQ ID NO: 589 - RNA, 1710 nt, Artificial Sequence
  derived and/or modified CDS sequence (wt) from Lassa virus__AIT17131__NP
augagugccucaaaggaaauaaaauccuuucuguggacacaaucacuaaggagggaauuaucugguuacugcuccaacaucaaacuacagguggugaaggaugcccaggcucuuuuacauggacuugacuucuccgaggucaguaauguccaacgguugaugcgcaaggagagaagggaugacaaugauuugaaacggcugagggaccuaaaucaagcggucaacaaccuuguugaguugaaaucaacucaacaaaagagcauacugagaguugggacucuaagcucagaugacuuauuggucuuagccgcugaucuagagaagcugaaaucaaaggugaccaggacagaaaggccauugagugcgggugucuauaugggcaaccugagcucacagcaacuugaccaaagacgagcucuucugaauaugauaggaaugaguggugguaaucaaggggcucgggcugggagagauggaguggugagaguuugggauguaaaaaaugcagaauugcuuaauaaucaguucgggaccaugccaagucuuacacuggcaugucugacaaaacaggggcagguugacuugaaugaugugguucaagcauugacagauuugggucuaaucuacacagcaaaguaucccaauacuucagacuuagauaggcugacucaaagucaccccauccuaaacaugguugacaccaagaaaagcucuuugaauauuucagguuauaacuuuagcuugggugcagcugugaaggcaggagcuugcaugcuggaugguggcaauauguuggagacaaucaaggugucaccucagacaauagaugguauccucaaauccaucuuaaaagucaagaaggcucuugggauguucaucucggacaccccuggugaaaggaauccuuaugagaacauacucuacaagauuuguuugucaggagauggauggccauauauugcaucaagaaccucaauaacaggaagggccugggaaaacacugucguugaucuagaaucagaugggaagccacagaaagcuggaagcaacaauuccaauaaaucccugcagucggcaggguucaccgcugggcuuaccuauucucaacugaugacccucaaggaugcuaugcugcaacuugacccaaaugcuaagaucuggauggacauugaagggagaccugaagauccaguggaaauugcccucuaucaaccaaguucaggcugcuacauacacuucuuccgugaaccuacugacuuaaagcaguucaagcaggaugcuaaguacucacaugggauugauguuacagaccucuuugcugcacaaccgggcuugaccagugcugucauagaugcacucccucggaauauggucauuaccugucagggggcugaugacauaaggaaacuccuugaaucacaagguagaaaagacaucaaacuaauugauauugcccucaacaaggcugauucuaggaaguaugaaaaugcagucugggaucaguacaaagacuuaugccacaugcacacagguguuguuguugaaaagaagaaaagaggcgguaaagaggagauaaccccucacugugcacuaauggacugcaucauguuugacgcagcagugucaggaggacugaacacaucaguuuugagggcagugcugccuagagauaugguguucagaacaucaacaccuagagucguucuguaa

SEQ ID NO: 590 - RNA, 1710 nt, Artificial Sequence
  derived and/or modified CDS sequence (wt) from Lassa virus__AIT17139__NP
augagugccucaaaggaaauaaaauccuuuuuguggacacaaucuuugaggagggaguuaucugguuacuguuccaacaucaaacuacagguggugaaagaugcucaggcccuuuuacauggacuugacuuuuccgaagucaguaauguucaacgguugaugcgcaaggagaggagggaugacaaugauuugaaacgguugagagaccugaaucaagcggugaacaaucuuguugaauuaaaaucaacucaacaaaagaguguacugaggguugggacucuaaccucagaugacuuguugaucuuggccgcugaucuagagaaguugaagucaaaggugaccagaacagaaaggccacugagugcaggugucuauaugggcaaccuaagcucacagcaacuugaccaaagaagagcucuucugaauaugauagggaugagugguggcaaucaaggggcucgggcugggagagauggagugguaagaguuugggaugugaagaaugcagaguugcucaauaaucaguucggaaccaugccaagccugacacuggcaugucugacaaaacaggggcagguugacuugaaugaugcaguacaggcacugacagauuuggguuugaucuacacagcaaaguaucccaauacuucagacuuagacaggcugacucaaagucaccccauccuaaauaugauugacaccaagaaaagcucuuugaauaucucagguuauaauuuuagcuugggugcagcugugaaggcaggagccugcaugcuggaugguggcaacauguuggagacaaucaaagugucaccucagacaauggauaguauccucaaauccauuuuaaaagucaaaaaggcucuagggauguucauuucagacaccccuggugaaaggaauccuuaugaaaacauacucuacaagauuuguuuaucaggagauggauggccauauauugcaucaagaaccucaauaacaggaagggccugggaaaacacuguuguugaucuggaaucagaugggaagccacagaaagcuggcagcaacaauuccaauaaaucccugcagucggcgggguuugcagcugggcucaccuauucucagcugaugacccucaaggaugcaaugcugcaacuugacccaaaugcuaagaccuggauggacauugaaggaagaccugaagauccaguggaaauagcccucuaucaaccaaguucagguugcuacauacacuucuuccgugaaccuacugauuuaaagcaguucaagcaggaugcuaaguacucacaugggauugaugucacagaccucuuugcugcacaaccuggcuugaccagugcuguuauugaugcacucccccggaauauggucauuaccugucagggaucugaugacauaagaaaacuccuugaaucacaaggaagaaaagacaucaaauuaauugauauugcccucagcaagacugauuccaggaaguaugaaaaugcagucugggaucaauauaaagaccuaugccacaugcacacagguauuguuguugagaagaagaaaagaggcgguaaagaggaaauaaccccucacugugcacuaauggacugcaucauguuugaugcagcagugucaggggggcugaacacaucaguuuugagagcagugcugcccagagauaugguguucagaacaacgacaccuagagucguccuguaa

SEQ ID NO: 591 - RNA, 1710 nt, Artificial Sequence
  derived and/or modified CDS sequence (wt) from Lassa virus__AIT17143__NP
augagugccucaaaggaaauaaaauccuuuuuguggacacaaucuuugaggagggaauuaucugguuacugcuccaacauaaagcugcagguggugaaagaugcccaggcucuuuuacauggacuugacuucucugaagucagcaauguucaacgguugaugcgcaaggagaggagggaugacaaugauuugaaacgguugagggaucuaaaucaagcggucaacaaucuuguugaauuaaaaucaacccaacaaaagaguauacugagaguugggacucuaaccucagaugacuuacuaaucuuggccgcugauuuagagaaauugaagucgaaggugaccagaacagaaaggccauugagugcaggugucuauaugggcaaccuaagcucacagcaacuugaccaaagaagagcucuucugaacaugauaggaaugagugguaguaaucaaggggcucgggcugggagagauggaguggucagaguuugggaugugaaaaaugcagaguugcucaauaaucaguucgggaccaugccaagucugacacuggcaugucugacaaaacaggggcagguugacuugaaugaugcaguacaagcauugacagauuuggguuugaucuacacagcaaaguauccaaauacuucagacuuggacaggcugacucaaagucaccccauccuaaauaugauugacaccaaaaaaagcucuuugaauaucucagguuauaauuuuagcuugggugcagcugugaaggcaggagcuuguaugcuggaugguggcaauauguuggagacaaucaaggugucaccucagacaauggaugguauucucaaauccauuuuaaagguuaaaaaggcucuugggauguucauuucagacaccccuggugaacggaauccuuaugaaaacauacucuacaagauuugcuugucaggagauggauggccauacauugcaucaagaaccucaauaacaggaagggccugggaaaacacuguuguugaucuggagucagaugggaagccacagaaagcuggcaacaacgguuccaauaaaucucugcagucggcaggauuuaccgcugggcuuaccuauucucagcugaugacccucaaggaugcaaugcugcaacuugacccaaaugcuaagaccuggauggacauugaaggaagaccugaagauccaguggagaucgcccucuaucaaccaaguucaggaugcuacauacacuucuuccgugaaccuacugacuuaaagcaauucaagcaggaugcuaaguacucacaugggauugaugucacagaucucuucgcugcacaaccgggcuugaccagugcugucauugaugcacucccccggaauuuggucaucaccugccaggggucugaugauauaaggaaacuccuugaaucacaaggaagaaaagacaucaaacuaauugacauugcccucagcaagacugauuccaggaaguaugaaaaugcagucugggaucaguacaaagaccuaugccacaugcacacagguauuguuguugagaagaagaaaagaggcggcaaagaggagauaaccccucacugugcacuaauggacugcaucauguuugaugcagcggugucaggaggacugaacacaucaguuuugagagcagugcugcccagagauaugguguuuagaacaucaacaccuagggucguccuguaa

SEQ ID NO: 592 - RNA, 1710 nt, Artificial Sequence
  derived and/or modified CDS sequence (wt) from Lassa virus__AIT17147__NP
augagugccucaaaggaaauaaaauccuuuuuguggacacaauccuugaggagggaauuaucugguuacugcucuaacaucaaacuacagguggugaaagaugcucaggcucuuuuacauggacuugacuucucugaagucaguaauguucaacgguugaugcgcaaggagagaagggaugacaaugauuuaaaacgguugagggaccuaaaucaagcggucaacaaucuuguugaauuaaaaucaacucaacaaaaaaguguacugagaguugggacucuaaccucagaugacuuauuaaucuuggccgcugaucuagaaaaguugaaaucaaaggugaccagaacagagaggccacugagugcaggugucuauaugggcaaccuaagcucacagcaacuugagcaaagaagagcucuucugaacaugauaggaaugagugguagcaaucaaggggcucaggcugggagagauggagugguuagaguuugggaugugaaaaaugcagaguugcucaauaaucaguucgggaccaugccaagucugacauuggcaugucugacaaaacaggggcagguugacuugaaugaugcaguacaagcauugacagauuuagguuugaucuacacaguaaaguaucccaauacuucagacuuagauaggcugacucaaagucaccccauccuaaauaugauugacaccaagaaaagcucuuugaauaucucagguuauaauuucagcuugggugcagcugugaaggcaggagcuuguaugcuggaugguggcaacauguuggagacaaucaaggugucaccucagacaauggaugguauucucaaauccauuuuaaaggucaagaaggcucuugggauguucauuucagauaccccuggugaaaggaauccuuaugagaacauacucuacaagauuuguuugucaggagauggauggccauacauugcaucaaggaccucaauaacaggaagggccugggaaaacacuguuguugauuuggagucagaugggaagccacagaaagcugacagcaacaguuccaauaaaucucugcagucagcaggguuuaccgcugggcuuaccuauucucagcugaugacccucaaggaugcaaugcugcaacuugacccaaaugcuaagaccuggauggacauugaaggaagaccugaagauccaguggaagucgcccucuaucaaccaaguucaggauguuacauacacuucuuccgugaaccuacugauuuaaagcaguucaagcaggaugcuaaguacucacaugggauugaugucacggaccucuucgcugcacaaccggguuugaccagugcagucauugaugcacucccccggaauauggucaucaccugucaggggucugaugacauaaggaaacuccuugaaucacaaggaagaaaggacauuaaacuaauugacauugcccucagcaaaacugauuccaggaaguaugaaaaugcagucugggaucaguauaaagacuuaugccacaugcacacagguguuguuguugagaagaagaaaagaggcggcaaagaggaaauaaccccucacugugcacuaauggacugcaucauguuugaugcagcagugucaggaggacugaacacaucaguuuugagagcagugcugccuagagauaugguguucagaacaucgacaccuagagucguccuguaa

SEQ ID NO: 593 - RNA, 1710 nt, Artificial Sequence
  derived and/or modified CDS sequence (wt) from Lassa virus__AIT17151__NP
augagugccucaaaggaaauaaaguccuuucuguggacacaaucauugagaagggaacuaucugguuacugcuccaacaucaaacuacagguugugaaagaugcccaagcucuuuuacauggacuugauuucuccgaagucagcaauguucaacggcugaugcgcaaggagagaagggaugacaaugaucugaaacgguugagggaccuaaaucaagcggucaacaaccuuguugaguuaaaaucaacucaacaaaagaguauacugagaguugggacucuaacaucagaugacuuauuaaucuuagccgcugaucuagagaaguugaaaucaaaggugaccaggacagaaaggccauugagugcaggugucuauaugggcaaccugagcucacagcaacuugaccagagacgagcucuucugaguaugauaggaaugaguggugguaaucaaggggcucgggcugggagagauggaguggugagaguuugggaugugaaaaaugcagaguugcuuaacaaucaguucgggaccaugccaaguuugacacuggcaugucugacaaagcaggggcagguugaccugaaugauguagugcaagcauugacagauuugggucugauuuacacagcuaaguaucccaauacuucagacuuagauaggcugacucagagucaccccauccuaaacaugauugacaccaagaaaagcucucugaauaucucaggcuauaauuucagccugggugcagcugugaaggcaggagcuugcaugcuagauggcggcaacaugcuggagacaauuaaggugucaccucagacgauggacggcauccucaaauccaucuuaaaggucaagaaggcucuugggauguucaucucagacaccccuggugaaaggaauccuuaugaaaacauacucuacaagauuuguuugucaggagauggauggccauauauugcaucaagaaccucaauaacaggaagggccugggaaaacacugucguugaucuggaaucagaugggaagcuacagaaagcuggcagcaacaauuccaacaaauccuugcagucggcaggguuuaccgcugggcuuaccuauucucagcuaaugacccucaaggaugcaauguugcaacuugacccaaaugccaagaccuggauggacauugaaggaagaccugaagauccaguggagauugcccucuaucaaccaaguucaggcugcuacauacacuucuuccgugagccuacugacuuaaagcaguucaagcaggaugcuaaguacucacaugggauugauguuacggaccucuucgcugcacagccggguuugaccagugcugucauugaugcacucccccggaauauggucauuaccugucagggguccgaugacauaaggaaacuccuugaaucacaagguagaaaagacaucaaacuaauugauauugcccucaacaaaacugauuccaggaaguaugaaaaugcagucugggaucaguauaaggacuuaugccacaugcacacaggugucguuguugaaaagaagaaaaagggcggcaaagaggaaauaaccccucacugugcacuaauggacugcaucauguuugaugcagcagugucaggaggacugaacacaucgguuuugagagcagugcugccuagagauaugguguucagaacaucgacaccuagagucguccuguaa

SEQ ID NO: 594 - RNA, 1710 nt, Artificial Sequence
  derived and/or modified CDS sequence (wt) from Lassa virus__AIT17155__NP
augagugccucaaaggaaauaaagucuuuucuguggacacaaucccugaggagggaacugucugguuacugcuccaacaucaaacuucaggugguaaaagaugcccaagcucuuuugcacggacuugacuucuccgaagucaguaauguucaacgguugaugcgcaaagagagaagggaugacaaugauuugaaacggcugagggaccuaaaucaagcggucaacaaccuuguugaguuaaaaucaacucaacagaagaguguacugagaguugggacccuaaccucagaugaguuauuagucuuggcugcugaucuagagaaauuaaaaucaaaagugaucaggacagaaaggccauugagugcaggugucuauaugggcaaccugagcucacagcaacuugaccaaaggcgagcucuucugaguaugauagggaugagugguggcaaucaaggggcucggacugggagagaugggguggugagaguuugggauguaaaaaaugcagaauugcucaauaaucaguucgggaccaugccaagucugacacuggcaugucugacaaaacaagggcagguugacuuaaaugaugcagugcaagcauugacagauuuggguuugaucuacacagcaaaguauccuaacacuucagacuuggauaggcugacucaaagucaccccauccuaaauaugauugacaccaagaaaagcucuuugaacaucucagguuauaauuuuagcuugggugcagcugugaaggcaggagcuuguaugcuggaugguggcaauauguuggagacaaucaaagugucaccucagacaauggauggcauccucaaauccauuuuaaaggucaagaaggcucuugggauguucauuucagacaccccuggugaaaggaaucccuacgaaaacauacucuacaagauuuguuugucaggggauggauggccauauauugcaucaagaaccucaauaacaggaagggccugggaaaacacugucguugaucuagagucagaugggaagccacagaaagcuggcagcaacaauuccaacaaaucccugcagucggcaggguuuacugcugggcuuacuuauucucagcuuaugacccucaaggaugcaaugcugcaacuugauccaaaugcuaagacuuggauggacauugaaggaagaccugaagauccaguggaaauugcccucuaucaaccaaguucaggcugcuacauacacuucuuccgugagccuacugauuuaaagcaguucaagcaagaugcuaaauacucacaugggauugaugucacagaccucuucgcugcacaaccgggcuuaacuagugcugucauagaugcacucccccggaauaugguuaucaccugucagggguccgaugauauaaggaaacuccuugaaucacaaggaagaaaggacaucaaauuaauugacauugcccucagcaaaauugauuccaggaaguaugaaaaugcagucugggaucaguauaaagacuuaugccacaugcacacaggugucguuguugaaaagaagaaaagaggcgguaaagaggaaauaaccccucacugugcacuaauggacugcaucauguuugaugcagcagugucaggaggacugaacucauuaguuuugagagcagugcugcccagagacaugguauucagaacaucgacaccaagagucguccuguaa

SEQ ID NO: 595 - RNA, 1710 nt, Artificial Sequence
  derived and/or modified CDS sequence (wt) from Lassa virus__AIT17161__NP
augagugccucaaaggaaauaaaauccuuuuuguggacacaauccuugaggagggaacuauccgguuacugcuccaacaucaaacuacagguggugaaagaugcccaggcucuuuuacauggacuugacuucucugaagucaguaauguucaacgguugaugcgcaaggagagaagggaugacaaugauuugaaacgguugagggaucuaaaucaagcggucaacaaucuuguugaauuaaagucaacucaacaaaagaguauacugagaguugggacucuaaccucagaugacuuguuaaucuuggccgcugaucuagagaaguugaagucaaaggugaccagaacagaaaggccauugagugcaggugucuauaugggcaaucuaagcucacagcaacuugaccaaagaagagcucuucugaacaugauaggaaugagugguaguaaucaaggggcucggacugggagagauggggugguuagaguuugggaugugaaaaaugcagaauugcucaauaaucaguucgggaccaugccaaguuugacacuggcaugucugacaaaacaggggcagguugacuugaaugaugcaguacaagcauugacagauuuagguuuaaucuacacagcgaaguauccuaacacuucagacuuagacaggcugacucaaagucaccccauccuaaauaugauugacaccaagaagagcucuuugaauaucucagguuauaauuuuagcuugggugcagcugugaaggcaggagcuugcaugcuggaugguggcaauauguuggagacaaucaaggugucaccucagacaauggaugguauucucaaauccauuuuaaagguuaagaaggcccuugggauguucauuucagauaccccuggugaaaggaauccuuaugaaaacauacucuacaagauuuguuugucaggagauggauggccauacauugcaucaagaaccucaauaacaggaagggccugggaaaacacugucguugaucuggaaucagaugggaagccacaaaaagcuggcagcaacaguuccaauaaaucucugcagucggcaggguuaaccgcugggcuuaccuauucucagcugaugacccucaaggaugcaaugcugcaacuugacccaaaugcuaagaccuggauggacauugaaggaagaccugaagauccaguggaaaucgcccucuaucaaccaaguucaggaugcuacauacacuucuuccgugaaccuacugauuuaaagcaguucaagcaggaugcuaaguacucacacgggauugauguuacggaccucuucgcugcacaaccgggccugaccagcgcuguuauugaugcacucccccgaaauuuggucauuaccugccaggggucugaugacauaaggaaacuccuugaaucacaaggaagaaaagacaucaaacuaauugacauugcccucagcaaaacugauuccaggaaguaugaaaaugcagucugggaccaguauaaagacuuaugccacaugcacacagguauuguuguugagaagaagaaaagaggcgguaaagaggaaauaaccccucacugugcacuaauggacugcaucauguuugaugcagcagugucaggaggacugaacgcaucaguuuugagagcagugcugcccagagauaugguguucagaacaucgacaccuagagucgucuuguaa

SEQ ID NO: 596 - RNA, 1710 nt, Artificial Sequence
  derived and/or modified CDS sequence (wt) from Lassa virus__AIT17165__NP
augagugccucaaaggaaauuaaauccuuuuuguggacacagucuuugaggagggaacuaucugguuacugcuccaacaucaaacuacagguugugaaagaugcccaagcucuuuuacauggacuugacuucuccgaggucaacaauguucaacgguugaugcgcaaggagagacgggacgacaaugacuugaaacgguugagggaccuaaaucaagcagucaauaaucuuguugaauuaaaaucaacucaacaaaagaguauacugagaguugggacucuaaccucagaugacuuauuaaucuuagccgcugaucuggagaaguugaagucaaaggugaccagaacagaaaggccauugagugcaggugucuacaugggcaaccuaagcucacagcaacuugaccagagaagagcucuccugaacaugauaggaaugaguaaugguaaucagggaacccgggcugggagagauggaguggugagaguuugggaugugaaaaaugcagaguugcucaauaaucaauucgggaccaugccaagucugacacuggcaugucugacaaaacaggggcagguugacuugaaugauguagugcaagcauugacagauuuggguuugaucuacacagcaaaguaucccaacacuucagacuuagacaggcugacucaaagucaccccauccuaaacaugauugacacuaagaaaagcucuuugaauaucuccgguuacaauuuuagcuugggugcagcugugaaggcaggagcuugcaugcuggauggugguaauauguuggagacaaucaaggugucaccucagacaauggaugguauccucaaauccaucuugaaggucaagaaggcucuugggauguuuauuucagauaccccuggugagaggaauccuuaugaaaacauacucuacaagauuuguuugucaggagauggauggccauauauugcaucgagaaccucaauaacaggaagggccugggagaacaccguuguugauuuggaaucagaugggaagccacagaaagcugacagcagcaauuccaacaaaucucugcagucggcaggguuuaccgcugggcucaccuauucucaacugaugacccucaaggaugcaaugcuacaacuugauccaaaugcuaagaccuggauggacauugaaggaagaccugaggauccaguggaaguugcccucuaucaaccaaguucaggcugcuacauacacuucuuccgugagccuacugauuuaaagcaguucaagcaggaugccaaguacucacaugggauugaugucacagaccucuucgcugcacaaccggguuugaccagugcugucauugacgcacucccccggaauauggucauuaccugucagggguccgaugacauaaggaaacuccuugaaucacaaggaagaaaggauaucaaacuaauugauauugcccucagcaaagcggauuccaggaaguaugaaaaugcagucugggaucagcauaaagacuuaugccacaugcacacagguguuguuguugaaaagaagaaaagaggcgguaaagaagaaauaaccccucacugugcacuaauggacugcaucauguaugaugcagcagugucuggaggauugaacacaucgguuuugagagcaguacugcccagagauaugguguucagaacaucgacaccuagagucguccuguaa

SEQ ID NO: 597 - RNA, 1710 nt, Artificial Sequence
  derived and/or modified CDS sequence (wt) from Lassa virus__AIT17169__NP
augagugccucaaaggaaauaaaguccuuucuauggacacaaucauugaggagggaauuaucugguuacugcuccaacaucaaacuacagguggugaaagaugcccaggcucuauuacauggacuugacuucucagaagucaguaauguucaacgguugaugcgcaaggagagaagggaugacaaugauuugaaacgguugagggaccuaaaucaagcggucaacaaccucguugaguuaaaaucaacucaacaaaagagcauauugagaguugggacccuaaccucagaugacuuauuaaucuuagccgcugaucuagagaaguuaaaaucaaaggugaucaggacagaaaggccauugagugcaggugucuauaugggcaacuugagcucacagcagcuugaccaaagacgagcucuucugaguaugauaggaaugaguagugguaaucaaagggcucaggcugggagggauggaguggugagaguuugggauguaaaaaauguagaguugcuuaauaaucaguucggaaccaugccaagucuaacacuggcaugucugacaaaacaggggcagguugauuugaaugaugcagugcaagcacugacagauuugggucugaucuacacagcaaaguauccuaauacuucagaccuagauaggcugacucaaagucaccccaucuuaaacaugauugacaccaagaaaagcucuuugaauaucucugguuacaauuucagcuugggugcagcugugaaggcaggagcuugcaugcuggaugguggcaauauguuggagacaaucaaggugucaccucagacaauggaugguauccucaaauccaucuuaaaggucaagaaggcucuugggauguucaucucagacaccccuggugaaaggaaucccuaugaaaacauacucuacaagaucuguuugucaggagauggauggccauauauugcaucaagaaccucgauaacaggaagagccugggaaaacacugucguugacuuggaaucagaugggaagccacagaaagcuggcagcaacaauucuaauaaauccuugcagucaguaggguuuacugcugggcuuaccuauucucagcugaugacccucaaggaugcgaugcugcaacuugacccaaacgcuaagacuuggauggacaucgaaggaagaccugaagauccaguggaaauugcccucuaucagccaaguucaggcugcuacauacacuuuuuccgugaaccuacugauuuaaagcaguucaagcaggaugcuaaguacucacaugggauugaugucacagaccucuucgcugcacaaccgggcuugaccagugcuguuauagaugcacucccccggaacauggucauuaccugucagggguccgaugacauaaggaagcuccuugagucacaagguagaaaagacaucaaauuaauugauauugcccucagcaaaacugauuccaggaaguaugaaaaugcagucugggaucaguauaaagaccuaugccacaugcacacagguguuguuguugaaaagaagaaaagaggcgguaaagaggaaauaaccccucacugugcacuaauggacugcaucauguuugaugcagcagugucaggaggacugaacacaucuguuuugagagcagugcugccuagagauaugguauucagaacaucgacaccuagagucguccuguaa

SEQ ID NO: 598 - RNA, 1710 nt, Artificial Sequence
  derived and/or modified CDS sequence (wt) from Lassa virus__AIT17173__NP
augagugccucaaaggaaauaaaauccuuuuuguggacacaauccuugaggagggaauuaucugguuacugcuccaacaucaaacugcagguggugaaggaugcccaggcucuuuuacaugggcuugacuucucugaagucaguaauguucaacgguugaugcgcaaggagagaagggaugacaaugauuuaaaacgguugagggaccuaaaucaagcagucaacaaucuuguugaauuaaaaucaacucaacaaaagaguauacugagaguugggacucuaaccucagaugacuuauuaaucuuggccgcugaucuagagaaguugaaaucgaaggugaccagaacagaaaggccauugagugcaggugucuauaugggcaaccuaagcucacagcaacuugaccaaagaagagcucuucugaacaugauaggaaugagugguaguaaucaaggggcucgggcugggagagauggaguggucagaguuugggaugugaaaaaugcagaguugcucaauaaucaguucgggaccaugccaagucugacacuggcaugucugacaaaacaggggcagguugacuugaaugaugcaguacaagcauugacagauuuagguuugaucuacacagcgaaguaccccaauacuucagacuuggacaggcugacucaaagucaccccauccuaaauaugauugacaccaagaaaagcucuuugaacaucucagguuauaauuuuagcuugggugcagcugugaaggcaggagcuugcaugcuggaugguggcaauauguuggaaacaaucaaggugucaccucagacaauggaugguauucucaaauccauuuuaaaggucaagaaggcucuugggauguucauuucagaugccccuggugaaaggaauccuuaugaaaacauacucuacaagauuuguuugucaggagacggauggccauacauugcaucaagaaccucaauaacaggaagggccugggaaaacacuguuguugaucuggaaucagaugggaagccacagaaagcuggcaguaacgguuccaauaaaucucugcagucggcaggauuuaccgcugggcucaccuauucucagcugaugacccucaaggaugcaaugcugcaacuugacccaaaugcuaagaccuggauggacauugaaggaagaccugaagauccaguggaaaucgcccucuaucaaccaaguucagggugcuacauacacuucuuccgugaaccuacugauuuaaagcaguucaagcaggaugcuaaguacucacaugggauugaugucacggaccucuucgcugcacagccgggcuugaccagugcugucauugaugcacucccccggaauauggucaucaccugccagggaucugaugacauaaggaaacucuuugaaucacaaggaagaaaagacauuaagcuaauugacauugcccucagcaagacugauuccaggaaguaugaaaaugcagucugggaucaguauaaagacuuaugccacaugcauacagguauuguuguugagaagaagaaaagaggugguaaagaggaaauaaccccucacugugcacuaauggacugcaucauguuugaugcagcaguaucaggaggacugaacacaucaguuuugagagcagugcugcccagagacaugguguucagaacaucgacaccuagggucguccuguaa

SEQ ID NO: 599 - RNA, 1710 nt, Artificial Sequence
  derived and/or modified CDS sequence (wt) from Lassa virus__AIT17177__NP
augagugccucaaaagagauaaaguccuucuuguggacacagucucugaggagggaacugucaggcuauugcucuaacaucaaauuacagguugugaaagaugcccaagcccuucugcauggacuugacuucucugaggucagcaauguccaacgguugaugcgcaaacaaagaagggaugauaaugaccuaaaacgacugagagauuuaaaucaggcagucaacaaucuuguugaauuaaaaucaacucaacaaaagaguguacugcgaguugggacucugaccucggaugacuuguuaguuuuagcugcugaccuagagaaacuaaaaucaaaggugaucaggacagaaagaccauugagcgcaggcauuuauaugggcaacuugagcucacagcaacuugaccaaagacgagcucuccuaaacaugauaggaaugagugguggcaaucaaggggcucgggcuggaagggauggaguggugaggguuugggaugugaagaaugcagaucuacuuaauaaucaguuugggaccaugccaagccugacauuggcgugucugacaaaacaagggcagguugaccuaaaugauguaguacaagcgcugacagaucuaggcuugaucuacacagcaaaguaucccaauacuucggaccuggacaggcugacucaaagccaccccauccuaaagaugauugacgcuaauaagagcucucuaaacaucucaggcuauaauuuuagcuugggugcagcugugaaggcaggagccuguaugcuggacggugggaacauguuagagacaaucaaagugucaccccaaacaauggacggcauucucaaguccauucuaaaggucaaaaagagccuugggauguucauuucagacaccccuggcgagagaaacccuuaugagaauauacucuacaaaaucugucugucaggggauggauggccauauauugcaucaaggacuucaauaauaggaagggccugggaaaacacuguuguugauuuggaaucagaugggaaaccacagaagacuggaagcaacaacuccagcaagucccuacaaucagcaggguuugcugcugggcucacuuauucucagcucaugacccuuaaggaugcaaugcugcagcuugauccaaaugcuaagaccuggauggacauugaaggaagaccugaagauccgguggagauugcucucuaucagccaaguucagguugcuauauucauuucuuccgugaacccacugaccuaaaacaguuuaaacaagaugcuaaguauucacauggaauugaugucacagaccuuuuugcugcacagccaggacuaacuagugcuguaauagaagcacucccccggaacauggucaucaccugucaggguucugaugacauaagaaaacuucuugaaucacagggaagaaaagauaucaagcugauugauauugcucucagcaaaacugauucuaggaaguaugagaacgcagucugggaccaguacaaagacuuaugccacaugcacacagguauuguuguugagaagaaaaagagaggcggcaaagaagaaauaaccccucauugugccuuaauggacugcaucauguuugaugcagcagugucaggaggacugaacacacugguuuuaagggcagugcugcccagagauaugguguucagaacaucaacacccaaggucguccuguaa

SEQ ID NO: 600 - RNA, 1710 nt, Artificial Sequence
  derived and/or modified CDS sequence (wt) from Lassa virus__AIT17181__NP
augagugcuucaaaggagguaaaguccuucuuguggacacaaucccugaggagggagcuguccgguuauuguuccaauaucaaacuacagguagugaaagaugcccaagcccuuuugcauggacuugauuucucugaggucagcaauguccaacgguugaugcgcaaacagagaagggaugacaaugaccugaaacggcugagggaucuaaaucaagcagucaacaaccuuguugagcugaaaucuacccaacagaaaagugugcugagaguaggaacucuaaccucagaugaucuguugguuuuggcugcugaccuggagaagcugaaaucaaaagugaucaggacagaaaggccauugagcgcaggugucuauaugggcaacuugagcucacagcaacuagaccaaagacgggcucuccugaauaugauaggaaugagugguggcauucaagggacucguacugggagagauggagugguaagagucugggauguaaaaaaugcagaccuacuuaacaaucaguucggcacuaugccaagucugacauuggcauguuuaacaaaacaaggacagguugaccugaaugauguggugcaggcacugacagaucugggccugauuuauacagcaaaguacccuaaugccucagacuuagauagguugacucagagucaccccaucuuaaacaugauugauaccaaaaaaaguucccuaaauaucucagguuacaacuucagucugggugcagcugugaaggcaggagcuugcaugcuggauggugguaacauguuggagacaaucaaggugucaccucagacaauggauggcauccucaagucuauccuaaagguaaaaaagacucuugggauguucaucucagacaccccuggugaaaggaauccuuaugagaacauacuuuacaagauuugucugucaggagauggauggccauauauugcaucaagaacuucaauuacaggaagggccugggaaaacacugucguugaucuggaaucagaugggaagccacagaaggcugggagcaacaauucuaacaaaucccugcagucagcaggcuuugccgcugggcucacuuauucucagcuuaugacccucaaagaugcaaugcugcagcuugaucccaaugcuaaaaccuggauggacauugagggaagaccugaagacccaguggagauugcucucuaucagccaaguucagguugcuacauucacuucuuccgugaaccuacugauuuaaagcaguucaagcaagaugcuaaauauucacauggaauugaugucacagaccucuucgccgcacaaccaggcuugaccagugcugucauagaggcacuuccccggaacauggucaucaccugucagggaucugaugacauaaagaaacuccuugaaucacagggaagaaaggauaucaaacuaauugacaucgcccucaguaaaacugauuccaggaaguaugaaaacgcagucugggaucaauauaaggacuuaugccauaugcacacagguguuguuguugaaaagaagaaaagaggcggcaaggaggagauaacaccucacugugcuuugauggacugcauuauguuugacgcagcagugucaggaggauugaacacauuggucuugagagcgguucuaccuagagacaugguguuuagaacaucgacacccagagucguccuguaa

SEQ ID NO: 601 - RNA, 1710 nt, Artificial Sequence
  derived and/or modified CDS sequence (wt) from Lassa virus__AIT17185__NP
augagugccucaaaggagauaaaguccuucuuguggacacaaucuuugaggagggaacugucugguuauuguuccaauauuaaauuacaaguggugaaggaugcccaagcucuuuuacauggacuugauuucucugagguuagcaauguucagcgauugaugcgcaaacagagaagggaugauggugaucuaaaacgguuaagggaucuuaaucaagcagucaacaaccuuguugaguugaaaucaacucaacaaaagaguguguugaggguugggacuuugaccucagaugaccuguuaauuuuggcugcugaucuagagaagcugaaaucaaagguaaccaggacagaaaggccguugagugcagguguuuauauggguaaccugaguucacaacaacuugaccagagacgggcucucuuaaacaugauaggaaugaguggugguaaucgaggggcucggaccggaaaagauggaguggugagaauuugggaugugaaaaaugcggacuugcucaacaaucaguucgguaccaugccaaguuugacacuggcaugucuaacaaaacaagggcagguugaccugaaugauguugugcaagcgcuaacagauuuggguuugaucuacacagcaaaauaucccaacacuucggacuuggacaggcugacccagagccaccccauucuaaauaugauagacaccaacaagagcucccugaacaucucugguuacaauuuuagucugggugcagcuguuaaggcaggagcuugcaugcuagauggugguaauaugcuggagacaaucaaggugucaccucagacaauggauggcauccucaaguccauucuaaagguuaaaaagagucuugggauguucauaucagacaccccuggcgaaaggaauccuuaugaaaauauacucuauaaaauuugucugucaggagauggguggccguacauugcaucaagaacuucaauaacaggaagggccugggaaaacacugucguugaucuagaaucagaugagaagccacaaaaagcugggagcaacaauuccaacaaaucccuacagucaacaggguucacugccgggcuuaccuauucucagcuuaugacucucaaagaugcaauguugcagcuugauccaaaugcaaagaccuggauggacauugaagggagaccugaagauccgguggaaaucgcuuuguaucagccaaguucaggcugcuacauacacuucuuccgugagcccacugauuuaaagcaguucaagcaagaugcuaaguacucacaugggauugaugugacagaccucuuugcugcacaaccaggcuuaacuagugcugucauagacacacucccucggaacauggucauuaccugccaggggucugaugacauaaggaaacuccuugaaucacagggaagaaaagauaucaaacuaauugauauugcccucagcaaaacugauucaaggaaauaugaaaaugcagucugggaucaguauaaagauuuaugccauaugcacacagguguugucguugagaagaagaaaagaggugguaaagaggaaauaaccccucacugugcucuaauggacugcaucauguuugaugcagcaguuucaggaggacugaaugcgucgguucugagagcugugcuaccuagagauaugguguuuagaacaucgacaccuagagucguccuguaa

SEQ ID NO: 602 - RNA, 1710 nt, Artificial Sequence
  derived and/or modified CDS sequence (wt) from Lassa virus__AIT17189__NP
augagugccucaaaggaaauaaaguccuuucuguggacacaauccuugaggagggaacuaucugguuacugcuccaacaucaaacuucagguggugaaagaugcccaagcucuuuugcacggacuugacuucuccgaagucaguaauguucaacgguugaugcgcaaagagagaagggaugacaaugauuugaaacggcugagggaccuaaaucaagcggucaacaaucucguugaguuaaaaucaacucaacagaagaguguacugagaguugggacccuaaccucagaugacuuauuaaucuuagcugcugaucuagagaaguugaaaucaaaagugaccaggacagaaaggccauugagugcaggugucuauaugggcaauuugagcucacagcaacuugaccaaaggcgagcucuucugaguaugauagggaugagugguggcaaucaaggggcucggacugggagagaugguguggugagaguuugggauguaaaaaaugcagaguugcucaacaaucaguucgggaccaugccaagucugacacuggcauguuugacaaagcaaggacagguugacuuaaaugaugugguacaagcauugacagauuuggguuugaucuacacagcaaaguaucccaacacuucagacuuggauaggcugacucaaagucaccccauccuuaauaugauugacaccaagaaaagcucuuugaauaucucagguuauaauuuuagcuugggugcagcugugaaggcaggagcuugcaugcuggaugguggcaauauguuggagacaaucaaagugucgccucagacaauagauggcauccucaaauccauuuuaaaggucaaaaaggcucuugggauguucauuucagacaccccuggugagaggaaucccuacgaaaacauacucuacaagauuuguuugucaggggauggauggccauauauugcaucaaggaccucaauaacaggaagggccugggaaaacacugucguugaucuagaaucagaugggaagccacagaaagcuggcagcaacaauuccaacaaaucccugcagucggcaggguuuaccgcugggcuuacuuauucucagcucaugacccucaaggaugcaaugcugcaacuugauccaaaugcuaagaccuggauggacauugaaggaagaccugaagacccaguggaaauugcucucuaucaaccaaguucagguugcuacauacacuucuuccgugagccuacugauuuaaagcaguucaagcaagaugcuaaauacucacaugggauugaugucacagaccucuuugcugcacaaccgggcuuaaccagugcugucauagaugcacucccccggaauauggucaucacuugucagggguccgaugauauaaggaaacuccuugaaucacaagggaggaaggacaucaaauuaauugacauugcccucagcaaaacugauuccaggaaguaugagaaugcagucugggaucaguauaaagacuugugccacaugcacacaggugucguuguugaaaagaagaaaagaggcgguaaagaggaaauaaccccucacugugcacuaauggacugcaucauguuugaugcagcagugucaggaggacuuaacucguugguuuugagagcagugcugcccagagacaugguauucagaacaucgacaccuagagucguccuguaa

SEQ ID NO: 603 - RNA, 1710 nt, Artificial Sequence
  derived and/or modified CDS sequence (wt) from Lassa virus__AIT17193__NP
augagugccucaaaggaaauaaaguccuuucuguggacacaauccuugaggagggaacuaucugguuacugcuccaacaucaaacuucagguggugaaagaugcccaagcucuuuugcacggacuugacuucuccgaagucaguaauguucaacgguugaugcgcaaagagagaagggaugacaaugauuugaaacggcugagggaccuaaaucaagcggucaacaaccuuguugaguuaaaaucaacucaacagaagaguguacugagaguugggacccuaaccucagaugacuuauuaaucuuagcugcugaucuagagaaguugaaaucaaaagugaccaggacagaaaggccauugagugcaggugucuauaugggcaacuugagcucacagcaacuugaccaaaggcgagcucuucugaguaugauagggaugagugguggcaaucaaggggcucggacugggagagauggaguggugagaguuugggauguaaaaaaugcagaguugcucaacaaucaguucgggaccaugccaagucugacacuggcauguuugacaaaacaaggacagguugacuuaaaugaugcaguacaagcauugacagauuuggguuugaucuacacagcaaaguaucccaacacuucagacuuggauaggcugacucaaagucaccccauccuaaauaugauugacaccaagaaaagcucccugaauaucucagguuauaauuuuagcuugggugcagcugugaaggcaggagccugcaugcuggaugguggcaauauguuggagacaaucaaagugucaccucagacaauggauggcauccucaaauccauuuuaaaggucaaaaaggcucuugggauguucauuucagacaccccuggugagaggaaucccuacgaaaacauacucuacaagauuuguuugucaggggauggauggccauauauugcaucaagaaccucaauaacaggaagggccugggaaaacacugucguugaucuagaaucagaugggaagccacagaaagcuggcaacaacaauuccaacaaaucccugcagucggcaggguuuaccgcugggcuuacuuauucucagcucaugacccucaaggaugcaauguugcaacuugauccaaaugcuaagaccuggauggacauugaaggaagaccugaagacccaguggaaauugcucucuaucagccaaguucaggcugcuacauacacuucuuccgugaaccuacugauuuaaagcaguucaagcaagaugcuaaauacucacaugggauugaugucacagaccucuuugcugcacaaccgggcuuaaccagugcugucauagaugcacucccccggaauauggucaucaccugucagggguccgaugauauaaggaaacuccuugaaucacaaggaagaaaggacaucaaauuaauugacauugcccuuagcaaaacugauuccaggaaguaugagaaugcagucugggaucaguauaaagacuugugccacaugcacacaggugucguuguugaaaagaagaaaagaggcgguaaagaggaaauaaccccucacugugcacuaauggacugcaucauguuugaugcagcagugucaggaggacugaacucauugguuuugagagcagugcugcccagagacaugguauucagaacaucaacaccuagagucguccuguaa

SEQ ID NO: 604 - RNA, 1710 nt, Artificial Sequence
  derived and/or modified CDS sequence (wt) from Lassa virus__AIT17197__NP
augagugccucaaaggaaauaaaauccuuuuuguggacacaauccuugaggagggaauuaucugguuacugcuccaacaucaaacugcagguggugaaagaugcccaggcucuuuuacauggacuugacuucucugaagucaguaauguucaacgguugaugcgcaaggagagaagggaugacaaugacuugaaacgguuaagggacuugaaucaagcggucaacaaucuuguugaauuaaaaucaacucaacaaaagaguauacugagaguugggacucuaaccucagaugacuuauuaaucuuggccgcugaucuagagaaguugaagucgaaggugaucagaacagagaggccauugagugcaggugucuauaugggcaaccuaagcuuacagcaacuugaccaaagaagggcucuucugaauaugauaggaaugaguggcaguaaucaggggguucgggcugggagagauggaguggucagaguuugggaugugaaaaaugcagaguugcucaauaaucaguucgggaccaugccaagucugacacuggcaugucugacaaaacaggggcagguugacuugaaugaugcaguacaagcauugacagauuuagguuugaucuacacagcgaaguaucccaauacuucagacuuagacaggcugacucaaagucaccccauccuaaauaugauugacaccaaaaaaagcucuuugaacaucucagguuauaauuuuagcuugggugcagcugugaaggcaggagcuuguaugcuggaugguggcaauauguuggagacaaucaaggugucaccucagacaauggauggcauucucaaguccauuuuaaaggucaagaaggcucuugggauguucauuucagauaccccuggugaaaggaauccuuaugaaaacauacucuacaaaauuuguuugucaggagauggcuggccauacauugcaucaagaaccucaauaacaggaagggccugggaaaacacuguuguugaucuggaaucagaugggaagccacagaaagcuggcagcaacgguuccaauaaaucucugcagucggcaggauuuaccgcugggcuuaccuauucucagcugaugacccucaaggaugcaaugcugcaacuugacccaaaugcuaagaccuggauggauauugaaggaagaccugaagauccaguggaaaucgcccucuaucaaccaaguucaggaugcuacauacacuucuuccgugaaccuacugauuuaaagcaguucaagcaggaugccaaguacucacaugggauugaugucacggaccucuuugcugcacaaccgggcuugaccagugcagucauugaugcacucccccgaaacauggucaucacuugccaggggucugaugacauaaggaaacuccuugaaucacaaggaaggaaagacaucaagcuaauugacauugcccucagcaagacugauuccaggaaguaugaaaaugcagucugggaucaguauaaagacuuaugccacaugcacacagguauuguuguugagaagaagaaaagaggcgguaaagaggaaauaacuccucacugugcacuaauggacugcaucauguuugaugcagcagugucaggaggacugaacacaucgguuuugagagcagugcugcccagagauaugguguucagaacaucaacaccuagagucguccuguaa

SEQ ID NO: 605 - RNA, 1710 nt, Artificial Sequence
  derived and/or modified CDS sequence (wt) from Lassa virus__AIT17201__NP
augagugccucaaaggaaauaaaauccuuuuuguggacacaaucuuugaggagggaauuaucugguuacugcuccaacaucaagcugcagguggugaaggaugcccaggcucuuuuacaugggcuugacuucucugaagucaguaauguucaacgguugaugcgcaaggagagaagggaugacaaugauuugaaacgguugagggaccuaaaucaagcagucaacaaucuuguugaauuaaagucaacucaacaaaagaguauacugagaguugggacucuaaccucagaugacuuauuaaucuuggcugcugaucuagagaaguugaagucgaaggugaccagaacagaaaggccauugagugcaggugucuauaugggcaaccuaagcucacagcaacuugaucaaagaagagcucuucugaacaugauaggaaugagugguaguaaucaaggggcucgggcugggagagaugggguggucagaguaugggaugugaaaaaugcagaguugcucaauaaucaguucgggaccaugccaagucugacacuggcaugucugacaaaacaggggcagguugacuugaaugaugcaguacaagcauugacagauuuagguuugaucuacacagcgaaguaccccaauacuucagacuuagacaggcugacucaaagucaccccauccuaaauaugauugacaccaagaaaagcuccuugaacaucucagguuauaauuuuagcuugggugcagcugugaaggcaggagcuuguaugcuggaugguggcaauauguuggagacaaucaaggugucaccucagacaauggaugguauucucaaauccauuuuaaaggucaagaaggcucuugggauguucauuucagaugccccuggugaaaggaauccuuaugaaaacauacucuacaagauuuguuugucaggagacggauggccauacauugcaucaagaaccucaauaacaggaagggccugggaaaacacuguuguugaucuggaaucagaugggaagccacagaaagcuggcaguaacgguuccaauaaaucucugcagucggcaggauuuaccgcugggcucaccuauucucagcugaugacccucaaggaugcaaugcugcaacuugacccaaaugcuaagaccuggauggauauugaaggaagaccugaagauccaguggaaaucgcccucuaucaaccaaguucagggugcuacauacacuucuuccgugaaccuacugauuuaaagcaguucaagcaggaugcuaaguacucacaugggauugaugucacggaccucuucgcugcacaaccgggcuugaccagugcugucauugaugcacucccccggaauauggucaucaccugccaggggucugaugacauaaagaaacucuuugaaucacaaggaagaaaagacauuaaacuaauugacauugcccucagcaagacugauuccaggaaguaugaaaaugcagucugggaucaguauaaagacuuaugccacaugcauacagguauuguuguugagaagaagaaaagaggcgguaaagaggagauaaccccucacugugcacuaauggacugcaucauguuugaugcagcaguaucaggaggacugaacacaucaguuuugagagcagugcugcccagagacaugguguucagaacaucgacaccuagggucguccuguaa

SEQ ID NO: 606 - RNA, 1710 nt, Artificial Sequence
  derived and/or modified CDS sequence (wt) from Lassa virus__AIT17205__NP
augagugccucaaaggaaauaaaauccuuuuuguggacacaauccuugaggagggaacuauccgguuacugcuccaacaucaaacuacagguggugaaagaugcccaggcucuuuuacauggacuugacuucucugaagucaguaauguucaacgguugaugcgcaaggagagaagggaugacaaugauuugaaacgguugagggaucuaaaucaagcggucaacaaucuuguugaauuaaagucaacccaacaaaagaguauacugagaguugggacucuaaccucagaugacuuguuaaucuuggccgcugaucuagagaaguugaagucaaaggugaccagaacagaaaggccauugagugcaggugucuauaugggcaaccuaagcucacagcaacuugaccaaagaaaagcucuucugaacaugauaggaaugagugguaguaaucaaggggcucggauugggagagauggggugguuagaguuugggaugugaaaaaugcagaauugcucaauaaucaguucgggaccaugccaaguuugacacuggcaugucugacaaaacaggggcagguugacuugaaugaugcaguacaagcauugacagauuuagguuuaaucuacacagcgaaguauccuaacacuucagacuuagacaggcugacucaaagucaccccauccuaaauaugauugacaccaagaagagcucuuugaauaucucagguuauaauuuuagcuugggugcagcugugaaagcaggagcuugcaugcuggaugguggcaauauguuggagacaaucaaggugucaccucagacaauggaugguauucucaaauccauuuuaaagguuaagaaggcucuugggauguucauuucagauaccccuggugaaaggaauccuuaugaaaacauacucuacaagauuuguuugucaggagauggauggccauacauugcaucaagaaccucaauaacaggaagggccugggaaaacacugucguugaucuggaaucagaugggaagccacaaaaagcuggcagcaacaguuccaauaaaucucugcagucggcaggguuaaccgcuggacuuaccuauucucagcugaugacccucaaggaugcaaugcugcaacuugacccaaaugcuaagaccuggauggacauugaaggaagaccugaagauccaguggaaaucgcccucuaucaaccaaguucaggaugcuacauacacuucuuccgugaaccuacugauuuaaagcaguucaagcaggacgcuaaguacucacaugggauugauguuacggaccucuucgcugcacaaccgggccugaccagugcugucauugaugcacucccccguaauuuggucauuaccugccaggggucugaugacauaaggaaacuccuugaaucacaaggaagaaaagacaucaaacuaauugacauugcccucagcaaaacugauuccaggaaguaugaaaaugcagucugggaccaguauaaagacuugugccacaugcacacagguauuguuguugagaagaagaaaagaggcgguaaagaggaaauaaccccucacugugcacuaauggacuguaucauguuugaugcagcagugucaggaggacugaacgcaucaguuuugagagcagugcugcccagagauaugguguucagaacaucgacaccuagagucguccuguaa

SEQ ID NO: 607 - RNA, 1710 nt, Artificial Sequence
  derived and/or modified CDS sequence (wt) from Lassa virus__AIT17209__NP
augagugccucaaaggaaauaaaguccuuucuguggacacaaucauugagaagggaacuaucugguuacugcuccaacaucaaacuacagguugugaaagaugcccaagcucuuuuacauggacuugauuucuccgaagucagcaauguucaacggcugaugcgcaaggagagaagggaugacaaugaucugaaacgguugagggaccuaaaucaagcggucaacaaccuuguugaguuaaaaucaacucaacaaaagaguauacugagaguugggacucuaacaucagaugacuuauuaaucuuagccgcugaucuagagaaguugaaaucaaaggugaccaggacagaaaggccauugagugcaggugucuauaugggcaaccugagcucacagcaacuugaccagagacgagcucuucugaguaugauaggaaugaguggugguaaucaaggggcucgggcugggagagauggaguggugagaguuugggaugugaaaaaugcagaguugcuuaacaaucaguucgggaccaugccaaguuugacacuggcaugucugacaaagcaggggcagguugaccugaaugauguagugcaagcauugacagauuugggucugaucuacacagcuaaguaucccaauacuucagacuuagauaggcugacucagagucaccccauccuaaacaugauugacaccaagaaaagcucucugaauaucucaggcuauaauuucagccugggugcagcugugaaggcaggagcuugcaugcuagauggcggcaacaugcuagagacaauuaaggugucaccucagacgauggacggcauccucaaauccaucuuaaaggucaagaaggcucuugggauguucaucucagacaccccuggugaaaggaauccuuaugaaaacauacucuacaagaucuguuugucaggagauggauggccauauauugcaucaagaaccucaauaacaggaagggccugggaaaacacugucguugaucuggaaucagaugggaagcuacagaaaacuggcagcaacaauuccaacaaauccuugcagucggcaggguuuaccgcugggcuuaccuauucucagcuaaugacccucaaggaugcaauguugcaacuugacccaaaugccaagaucuggauggacauugaaggaagaccugaagauccaguggagauugcccucuaucaaccaaguucaggcugcuacauacacuucuuccgugagccuacugacuuaaagcaguucaagcaggaugcuaaguacucacaugggauugauguuacggaccucuucgcugcacagccggguuugaccagugcugucauugaugcacucccccggaauauggucauuaccugucagggguccgaugacauaaggaaacuccuugaaucacaagguagaaaagacaucaaacuaauugauauugcccucaacaaaacugauuccaggaaguaugaaaaugcagucugggaucaguauaaggacuuaugccacaugcacacaggugucguuguugaaaagaagaaaaagggcggcaaagaggaaauaaccccucacugugcacuaauggacugcaucauguuugaugcagcagugucaggaggacugaacacaucgguuuugagagcagugcugccuagagauaugguguucagaacaucgacaccuagagucguccuguaa

SEQ ID NO: 608 - RNA, 1710 nt, Artificial Sequence
  derived and/or modified CDS sequence (wt) from Lassa virus__AIT17211__NP
augagugccucaaaggaaauaaaauccuuuuuguggacacaauccuugaggagggaauuaucugguuacugcuccaacaucaaacuacagguggugaaagaugcccaggcucuuuuacauggacuugacuucucugaagucaguaauguucaacgauugaugcguaaagagagaagggaugacaaugauuugaaacgguugagggaccuaaaucaagcggucaacaaucuuguugaauuaaaaucaacucaacaaaagaguauacuaagaguugggacucuaaccucagaugacuuauugaucuuagccgcugaucuagagaaguugaagucaaaggugaccagaacagaaaggccacugagugcaggugucuauaugggcaacuuaagcucacagcagcuugaccaaagaagagcucuucugaacaugauaggaaugaguggugguaaucaaggggcucaggcugggagagauggaguaguuagagucugggaugugaaaaaugcagaguugcucaauaaucaguuugggaccaugccaagucugacacuggcaugucugacaaaacaggggcaaguugacuugaaugaugcaguacaagcauugacagauuuagguuugaucuacacagcgaaguaucccaauacuucagacuuagauaggcugacucaaagucaccccauccugaauaugauugacaccaagaagagcucuuugaauaucucagguuauaauuuuagcuugggugcagcugugaaggcaggagcuuguaugcuggaugguggcaacauguuggagacaaucaaggugucaccucagacaauggaugguauucucaaauccauuuuaaaggucaagaaggcucuugggauguucauuucagauaccccuggugaaaggaauccuuaugagaacauacucuacaagauuuguuugucaggagauggauggccauacauugcaucaagaaccucaauaacaggaagggccugggaaaacacugucguugauuuggaaucagaugggaagccacagaaagcuaacagcaacaguuccaauaaaucucugcagucggcaggguuuacugcugggcuuaccuauucucaguugaugacccucaaggaugcaaugcugcaacuugacccaaaugcuaagaccuggauggacauugaaggaagaccugaagauccaguggaaaucgcccucuaucaaccaaguucaggaugcuacauucacuucuuccgugaaccuacugaccuaaagcaguucaagcaggaugcuaaguacucacaugggauugaugucacggaccucuucgcugcacaaccggguuugaccagugcugucauugaugcacucccccggaauauggucaucaccugucaggggucugaugacauaaggaagcuccuugaaucacaaggaagaaaggacauuaaacuaauugacauugcccucagcaaaacugauuccaggaaguaugaaaaugcagucugggaucaguauaaagacuuaugccacaugcacacagguauuguuguugagaagaagaagagaggugguaaagaggaaauaaccccucacugugcacuaauggacugcaucauguuugaugcagcagugucaggaggacugaacacaucaguuuugagagcagugcugcccagagauaugguguucagaacaucgacaccuagagucguccuguaa

SEQ ID NO: 609 - RNA, 1710 nt, Artificial Sequence
  derived and/or modified CDS sequence (wt) from Lassa virus__AIT17213__NP
augagugccucaaaggaaauaaaauccuuuuuguggacacaauccuugaggagggaauuagcugguuacugcuccaacaucaaacugcagguggugaaagaugcccaggcucuuuuacauggacuugacuucucugaagucaguaauguucaacgguugaugcgcaaggagagaagggaugacaaugauuugaaacgguuaagggacuugaaucaagcagucaacaaucuuguugaauuaaaaucaacucaacaaaagaguguacugaggguugggacucuaaccucagaugacuuauuaauccuggccgcugaucuagagaaguugaagucgaaggugaucagaacagagaggccauugagugcaggugucuauaugggcaaccuaagcucacagcaacuugaccaaagaagggcucuucugaauaugauaggaaugaguggcaguaaucaagggguucgggcugggagggauggaguggucagaguuugggaugugaaaaaugcagaguugcucaauaaucaguucgggaccaugccaagucugacacuggcaugucugacaaaacaggggcagguugacuugaaugaugcaguacaagcauugacagaucuagguuugaucuacacagcgaaguaucccaauacuucagacuuagacaggcugacucaaagccaccccauccuaaauaugauugacacuaagaaaagcucuuugaacaucucagguuauaauuuuagcuugggugcagcugugaaggcaggggcuuguaugcuggaugguggcaauauguuggagacaaucaaggugucaccucagacaauggaugguauucucaaguccauuuuaaaggucaagaaggcucuugggauguucauuucagauaccccuggugaaaggaauccuuaugaaaacauacucuacaagauuuguuugucaggagauggcuggccauacauugcaucaagaaccucaauaacaggaagggcuugggaaaacacuguuguugaucuggaaucagaugggaagccacagaaagcuggcagcaacgguuccaacaaaucucugcagucggcaggauuuaccgcugggcuuacuuauucucagcugaugacccucaaggaugcaaugcugcaacuugacccaaaugcuaagaccuggauggauauugaaggaagaccugaagauccaguggaaaucgcccucuaucaaccaaguucaggaugcuacauacacuucuuccgugaaccuacugauuuaaagcaguucaagcaggaugccaaguacucacaugggauugaugucacggaccucuuugcugcacaaccgggcuugaccagugcagucauugaugcacucccccgaaauauggucaucaccugccaggggucugaugacauaaggaaacuccuugaaucacaaggaaggaaagacaucaaacuaauugacauugcccucagcaagacugauuccaggaaguaugaaaaugcagucugggaucaguauaaagacuuaugccacaugcacacagguauuguuguugagaagaagaaaagaggcgguaaagaggaaauaacuccucacugugcacuaauggacugcaucauguuugaugcagcagugucaggaggacugaacacaucgguuuugagagcagugcugcccagagauaugguguucagaacaucgacaccuagagucguccuguaa

SEQ ID NO: 610 - RNA, 1710 nt, Artificial Sequence
  derived and/or modified CDS sequence (wt) from Lassa virus__AIT17217__NP
augagugccucaaaggaaauaaaguccuuucuguggacacagucauugaggagggaauugucugguuauugcucuaacaucaaacuacagguggugaaagaugcgcaagcucuuuuacauggacuugacuucuccgaagucaguaauguucaacgguugaugcgcaaggagagaagggaugacaaugauuuaaaacgguugagggaccuaaaucaagcugucaacaaccuuguugaguuaaaaucaacucaacaaaaaaguauacugagaguugggacccuaaccucagaugacuuauuaauuuuagcugcugaucuagagaaguugaaaucaaaggugaccaggacagaaaggccauugagugcaggugucuauaugggcaaccugagcucacagcaacuugaccaaagacgagcucuucugaguaugauaggaaugaguagugguguucaaggggcucgggcugggagagauggaguggugagaguuugggauguaaaaaaugcagaguugcuuaauaaucaguucggaaccaugccgagucugacacuagcauguuugacaaaacaggggcagguugacuugaaugacguagugcaagcacugacagauuugggucuaaucuacacagcaaaguauccaaauacuucagauuuagauaggcugacucaaagucaccccauccugaacaugauugacaccaagaaaagcucucugaauaucucagguuauaauuuuagcuugggugcagcugugaaggcaggagcuugcaugcuggacgguggcaacauguuggagacaauuaaggugucaccucagacaauggauggcauccucaaguccaucuuaaaggucaagaaagcucuugggauguucaucucagagaccccuggugaaaggaacccuuaugagaacauacucuacaagauuugcuuaucaggagauggauggccauauauugcaucaagaaccucaauaacaggaagggcuugggaaaacacugucguugauuuggaaucagaugggaagccacagaaagcuggcagcaacaacuccaauaaaucccugcagucuacaggguuugcugcugggcuuaccuauucucagcugaugacccucaaagacgcaaugcugcaacuugacccaaaugcuaagaccuggauggacauugaaggaagaccugaagauccaguggagguugcccucuaucaaccaaguucaggcugcuacauacacuucuuccgugaacccacugauuuaaagcaguucaagcaggaugcuaaguacucacaugggauugauguuacagaccucuucgcugcgcaaccgggcuugaccagugcugucauagaugcacuuccccgaaauauggucauuaccugucaggggucugaugacauaaagaaacuccuugaaucacaagguagaaaagacaucaagcuaauugacauugcccucaguaaaacugauuccaggaaguaugaaaaugcagucugggaucaauauaaagacuuaugccacaugcacacagguguugucguugaaaagaagaaaagaggcgguaaagaggaaauaaccccucacugugcacuaauggacugcaucauguuugaugcagcaguaucaggaggacugaacacaucggucuugagagcagugcugcccagagauaugguguucagaacaucgacaccuagagucguccuguaa

SEQ ID NO: 611 - RNA, 1710 nt, Artificial Sequence
  derived and/or modified CDS sequence (wt) from Lassa virus__AIT17225__NP
augagugccucaaaggagauaaaguccuuccuguggacacaaucuuugaggagagaauugucugguuauugcuccaacaucaaacugcaaguggugaaggaugcucaagcucuucuacaugggcuugacuucucugaggucagcaauguccagcggcuaaugcgcaaacagagaagagacgauaaugauuugaagcgguugagggaucuaaaucaagcaguaaacaaccuuguugaguugaagucaacucaacaaaagagugugcugagaguugggacucugacuucagaugaccuauugguucuagcugcagacuuagagaagcuaaaaucaaaaguaacuagaacagaaaggccauugagcgcaggagucuacauggguaaccuaagcucgcaacaacuugaccagagacgagcucuccugaauaugauaggaaugaguggugguaaucagggggcccgggccgggaaugacggaguugugagaguuugggauguaaaaaaugcagacuuacuuaauaaccaguucggcaccaugccaagucugacacuggcauguuugacaaagcaagggcagguugaccuaaaugauguagugcaggcauuaacagaucugggucugaucuacacagcaaaguaccccaacacuucagacuuagacaggcuaacucagagccaccccauucugaacaugauagacaccaagaagagcuccuugaacaucucagguuacaauuuuagcuugggugccgcugugaaagcaggagccuguaugcuagauggugguaacauguuagaaacaaucaaggugucaccccagacaauggauggcauccuuaagucaauucuaaaaguuaaaaaggcucuagggauguucauuucagacaccccuggcgaaaggaauccuuaugaaaacauacucuacaagauuuguuugucaggggacggauggccauacauugcaucgaggacuucaauaacagggagggcuugggaaaacaccgucguugauuuagaaucagaugggaagccacagaaaacugggaacaacaguuccaauaaaucccuacagucggcaggguucacugcuggacucaccuauucucagcuuaugacccucaaagaugcaaugcugcaacuugauccaaaugcuaagaccuggauggacauugaagggagaccugaagauccgguggaaguugcccucuaucagccaaguucaggcugcuacauccauuucuuccgcgaaccuacugauuugaagcaguucaagcaggaugccaaguacucacauggaauugaugucacagaccucuuugcugcacagccaggcuugaccagugcugucauagaagcacuuccccggaacaugguuaucacuugucagggaucugacgauauaaggaaacuccuugaaucacaggggagaaaagacauuaaacuaauugacauugcccucagcaagauugauuccagaaaguaugaaaaugcaguuugggaucaauauaaggaccugugccacaugcacacgggugucguuguugaaaagaagaaaagagguggcaaagaggaaauaaccccucacugugcuuuaauggacugcaucauguuugaugcagcagugucaggaggauugaacacgcuaguucugagagcaguguugcccagagacaugguguuuagaacaucaacaccuaaggucguccuguaa

SEQ ID NO: 612 - RNA, 1710 nt, Artificial Sequence
  derived and/or modified CDS sequence (wt) from Lassa virus__AIT17229__NP
augagugccucaaaggaaauaaaguccuucuuguggacacaaucauugaggagggaauuaucugguuacugcuccaacaucaaacuacagguggugaaagaugcccaggcucuuuuacauggacuugacuucucugaagucaguaauguucaacgcuugaugcgcaaggagagaagggaugacaaugauuugaaacgauugagggaccuaaaucaagcggucaacaaccuuguugaguuaaaaucaacucaacaaaagaguguacugagaguugggacucuaaccucagaugacuuauuaaucuuagccgcugaucuagagaaguugaaaucaaaggugaucaggacagaaaggccauugagugcaggugucuauaugggcaacuugagcucacagcaacuugaccaaagacgagcucuucugagcaugauaggaaugaguggugguaaucaagggacucgggcugggagagauggaguggugagaguuugggauguaaaaaaugcagaguugcuuaacaaucaguucgggaccaugccaagucuaacacuggcaugucugacaaaacaggggcagguugacuugaaugaugcagugcaagcacugacagauuugggucuaaucuacacagcaaaguaucccaacacuucagacuuagauaggcugacucaaagucaccccaucuuaaacaugauugacaccaagaaaaguuccuugaauaucuccgguuauaacuuuagcuugggugcagcugugaaggcaggagcuugcaugcuggaugguggcaauauguuggagacaaucaaggugucaccucagacaauggauggcauccucaaauccaucuugaaggucaagaaggcucuugggauguucauaucagacaccccuggugaaaggaauccuuaugaaaacauacucuacaaaauuuguuugucaggagauggauggccauauauugcaucaaggaccucaauaacaggaagagccugggaaaacacugucguugacuuggaaucagaugggaagccacagaaagcuggcagcaacaacuccaauaaaucccuacagucggcaggguuuaccgcugggcuuaccuacucucagcugaugacccucaaggaugcgaugcugcaacuugacccaaacgcuaagacuuggauggacaucgaaggaaggccugaagauccgguggaaauugcccucuaucaaccaaguucaggcugcuacauacacuuuuuccgcgaaccuacugauuuaaagcaguucaagcaggaugcuaaguacucacaugggauugauguuacagaccucuucgcugcacaaccgggcuugaccagugcugucauagaugcacucccccggaauauggucauuaccugucaggggucugaugacauaaggaaacuccuugaaucacaaggcagaaaagacaucaaacuaauugacauugcccucagcaaagcugauuccaggaaguaugaaaaugcagucugggaucaguauaaagacuuaugccacaugcacacagguguugugguugaaaagaagaaaagaggcgguaaagaggaaauaaccccucauugugcacuaauggauugcauuauguuugaugcagcagucucaggaggacugaacacaucuguuuuaagagcagugcugccuagagacaugguauuuagaacaucaacaccuagagucguccuguaa

SEQ ID NO: 613 - RNA, 1710 nt, Artificial Sequence
  derived and/or modified CDS sequence (wt) from Lassa virus__AIT17233__NP
augagugcuucaaaggaaguaaaguccuuucuguggacacaaucauuaaggagggaauuaucugguuacuguuccaacaucaaacuacagguggugaaagaugcccaggcucuuuugcauggacuugacuucuccgaaguuagcaauguucaacgguugaugcgcaaggagagaagggaugacaaugauuuaaagcgguugagggaccuuaaucaagcggucaacaaucuuguugaguuaaaaucaacucaacaaaagaguauauugagaguugggaccuuaaccucagaugacuuauuagucuuagcugcugaucuagagaagcugaaaucaaaggugacuaggacagaaaggccauugagugcaggugucuacauggguaaccugagcucacagcagcuugaccagagacgagcucuucugagcaugauagggaugaguggugguaaucaaggggcucaggcugggagagauggaguggugagaguuugggaugugaaaaaugcagagcugcucaauaaucaguuugggaccaugccaagucuuacacuggcaugucugacaaaacagggacagguugacuugaaugaugcagugcaagcauugacagauuugggucugaucuacacggcaaaguaucccaauacuucagauuuggauaggcugacucaaagucaccccauccuaaacaugauugauaccaagaagagcucuuuaaacaucucagguuauaauuuuagcuugggugcagcugugaaggcaggagcuugcaugcuggaugguggcaacauguuggagacaaucaaggugucaccucagacaauggaugguauccucaaauccaucuugaaggucaagaaggcucuugggauguucaucucagacaccccuggugaaaggaauccuuaugaaaacauacucuacaagauuugccugucaggagacggguggccauacauugcaucaaggaccucaauaacaggaagggccugggaaaauacugucguugaucuggaaucagaugggaagccacagaaagcuggcagcaacaauuccaacaaaucucugcagucggcaggguuuacugcugggcuuaccuauucucagcugaugacccucaaggaugcaaugcugcaacuugauccaaaugcuaagaccuggauggauauugaaggaagaccugaagauccaguggaaguugcccucuaucaaccaaguucaggcuguuacauucacuucuuccgugaaccuacugauuugaagcaguucaaacaggacgcuaaguacucacaugggauugaugucacagaccucuucgcugcacaaccgggccugaccagugcugucauagaugcacucccucggaauaugguuauuaccugucagggguccgaugacauaagaaaacuccuugaaucacaagguaggaaagacaucaaacuaauugauauugcccucagcaaaacugauuccaggaaguaugaaaaugcagucugggaucaauauaaagacuuaugccacaugcacacaggugucguuguugagaagaagaaaaggggcgguaaagaggaaauaaccccucacugugcacuaauggacugcaucauguuugacgcagcagugucaggaggacugaacacaucgguuuugagagcagugcugcccagggauaugguguucagaacaucaacaccuagagucguccuguaa

SEQ ID NO: 614 - RNA, 1710 nt, Artificial Sequence
  derived and/or modified CDS sequence (wt) from Lassa virus__AIT17237__NP
augagugcuucaaaggaaauaaaguccuuucuguggacacaaucauuaaggagggaauuaucugguuacuguuccaacaucaaacuacagguggugaaagaugcccaggcucuuuugcaugggcuugacuucuccgaagucagcaauguucaacgguugaugcgcaaggagagaagggaugacaaugauuuaaagcgguugagggaccuuaaucaagcggucaacaaccuuguugaguuaaaaucaacucaacaaaagaguauauugagaguugggaccuuaaccucagaugacuuauugaucuuagcugcugaucuagagaagcugaaaucaaaggugacuaggacagaaaggccauugagugcaggugucuacauggguaaccugagcucacagcaacuugaccagagacgagcucuucugagcaugauagggaugaguggugguaaucaaggggcucgggcugggagagauggaguggugagaguuugggaugugaaaaaugcagaguugcucaauaaucaguucgggaccaugccaagucuuacacuggcauguuugacaaaacagggacagguugacuugaaugaugcagugcaagcauugacagauuugggucugaucuacacggcaaaguaucccaauacuucagacuuggauaggcugacucaaagucaccccauccuaaacaugauugacaccaagaagagcucuuuaaacaucucagguuauaauuuuagcuugggugcagcugugaaggcaggagcuugcaugcuggaugguggcaacauguuggagacaaucaaggugucaccucagacaauggaugguauccucaaauccaucuugaaggucaagaaggcucucgggauguucaucucagacaccccuggugaaaggaauccuuaugaaaacauacucuacaagauuugucugucaggagauggguggccauacauugcaucaaggaccucaauaacaggaagggccugggaaaacacugucguugaucuggaaucagaugggaagccacagaaagcuggcagcaacaauuccaacaaaucccugcagucggcaggguuuaccgcugggcuuaccuauucucagcuaaugacucucaaggaugcaaugcugcaacuugauccaaaugcuaagaccuggauggauauugaaggaagaccugaagauccaguggaaguugcccucuaucaaccaaguucaggcuguuacauucacuucuuccgugaaccuacugauuuaaagcaguucaaacaggaugcuaaguacucacaugggauugaugucacagaccucuucgcugcacaaccgggccugaccagugcugucauagaugcacucccucggaauauggucauuaccugucagggguccgaugacauaaggaaacuccuugaaucacaagguaggaaagacaucaaacuaauugacauugcccucagcaaaacugauuccaggaaguaugagaaugcagucugggaucaguauaaagacuuaugccacaugcacacaggugucguuguugagaagaagaaaagaggugguaaagaggaaauaaccccucacugugcacuaauggacugcaucauguuugacgcagcagugucaggaggacugaacacaucaguuuugagagcagugcugcccagggauaugguguucaggacaucaacaccuagagucguucuguaa

SEQ ID NO: 615 - RNA, 1710 nt, Artificial Sequence
  derived and/or modified CDS sequence (wt) from Lassa virus__AIT17241__NP
augagugccucaaaggaaauaaaguccuuuuuguggacacagucauugaggagggaauuaucugguuacugcucuaacaucaaauuacagguggugaaagaugcccaagcucuuuuacauggacuugacuucuccgaagucaguaauguucaacgacugaugcgcaaggagagaagggaugauaaugauuugaaacgacugagggaccuaaaucaagcggucaauaaccuuguugaguuaaaaucaacucaacaaaagaguauacugagaguugggacucuaacaucagaugauuuauuaaucuuagccgcugaucuagagaaguugaaaucaaaggugaccaggacagaaaggccauugagugcaggugucuauaugggcaaccugagcucacagcaacuugaccaaagacgagcucuucugaguaugauaggaaugaguggugguaaucaaggggcucgggcuggaagagauggaguggugagaguuugggauguaaaaaaugcagaguugcuuaacaaucaguucgggaccaugccaagucugacacuagcaugucugacaaagcaggggcagguugacuugaaugaugcggugcaagcauugacagauuugggucugaucuacacagcaaaguaucccaacacuucagacuuagauaggcugacucaaagucaccccauccuaaacaugauugacaccaagaaaagcucuuugaacaucucagguuacaauuuuagccugggugcagcugugaaggcaggagcuugcaugcuggaugguggcaauauguuggagacaaucaaggugucaccucagacgauggacgguauccucaaauccaucuuaaaggucaagaaggcucuugggauguucaucucagacaccccuggugaaaggaauccuuaugaaaacauacucuauaagauuuguuugucaggagacggauggccauauauugcaucaagaacuucaauaacaggaagggcuugggaaaacacugucguugaucuggaaucagaugggaagccacagaaagcuggcagcaacaauuccaauaaauccuugcagucggcaggguucaccgcugggcuuaccuauucucagcuaaugacccucaaggaugcaauguugcaacuugacccaaaugcuaagaccuggauggacauugaaggaagaccugaagauccaguggaaauugcccuuuaucaaccaaguucaggcugcuacauacacuucuuccgugaaccuacugauuuaaagcaguucaagcaggaugcuaaguauucacaugggauugauguuacagaccucuucgcugcacaaccgggcuugaccagugcugucauugaugcacucccccggaauauggucauuaccugucagggguccgaugacauacggaaacucuuugaaucgcaagguaggaaagacaucaaacugauugauauugcccuuagcaaaacugauuccaggaaguaugaaaaugcaguuugggaucaguauaaggacuuaugccacaugcacacaggugucguuguugaaaagaagaaaagaggcggaaaagaggaaauaaccccucacugugcacuaauggacugcaucauguuugaugcagcagugucagggggacugaacacaucgguucugagagcagugcugccuagagauaugguguucaggacaucgacaccuagagucguccuguaa

SEQ ID NO: 616 - RNA, 1710 nt, Artificial Sequence
  derived and/or modified CDS sequence (wt) from Lassa virus__AIT17245__NP
augagugccucaaaggaaauaaaguccuuuuuguggacacaauccuugaggagggaacuauccgguuacugcuccaacaucaaacuacagguggugaaagaugcccaggcucuuuuacauggacuugacuucucugaagucaguaauguucaacgguugaugcgcaaggagaggagggaugacaaugauuugaaacgguugagggaucuaaaucaagcggucaacaaucuuguugaauuaaagucaacucaacaaaagaguauacugagagucgggacucuaaccucagaugacuuguuaaucuuggccgcugaucuagagaaguugaagucaaaggugaccagaacagaaaggccauugagugcaggugucuauaugggcaaccuaagcucacagcaacuugaccaaagaagagcucuucugaacaugauaggaaugagugguaguaaucaaggggcucggacugggagagauggggugguuagaguuugggaugugaaaaaugcagaauugcucaauaaucaguucgggaccaugccaaguuugacacuagcaugucugacaaaacaggggcagguugacuugaaugaugcaguacaagcauugacagauuuagguuuaauuuacacagcgaaguauccuaacacuucagacuuagacagguugacucaaagucaccccauccuaaauaugauugacaccaagaagagcucuuugaauaucucagguuauaauuuuagcuugggugcagcugugaaggcaggagcuugcaugcuggaugguggcaauauguuggagacaaucaaggugucaccucagacaauggaugguauucucaaauccauuuuaaagguuaagaaggcucuugggauguuuauuucagauaccccuggugaaaggaauccuuaugaaaacauacucuacaagauuuguuugucaggagauggauggccauacauugcaucaagaaccucaauaacaggaagggccugggaaaacacugucguugaucuggaaucagaugggaagccacaaaaagcuggcagcaacaauuccaauaaaucucugcagucggcaggguuaaccgcugggcuuaccuauucucagcugaugacccucaaggaugcaaugcugcaacuugacccaaaugcuaagaccuggauggacauugaaggaagaccugaagauccaguggaaaucgcucucuaucaaccaaguucaggaugcuacauacacuucuuccgugaaccuacugauuuaaagcaguucaagcaggaugcuaaguacucacaugggauugauguugcggaccucuucgcugcacaaccgggucugaccagugcuguuauugaugcacucccccgaaauuuggucauuaccugccaggggucugaugacauaaggaaacuccuugaaucacaaggaagaaaagacaucaaacuuauugacauugcccuuagcaaaacugauuccaggaaguaugaaaaugcagucugggaccaguauaaagacuuaugccacaugcacacagguauuguuguugagaagaagaaaagaggcgguaaagaggaaauaaccccucacugugcacuaauggacugcaucauguuugaugcagcagugucaggaggacugaacgcaucaguuuugagagcagugcugcccagagauaugguguucagaacaucgacaccuagagucgucuuguaa

SEQ ID NO: 617 - RNA, 1710 nt, Artificial Sequence
  derived and/or modified CDS sequence (wt) from Lassa virus__AIT17247__NP
augagugccucaaaggagauaaaguccuucuuguggacacaaucuuugaggagggaguugucugguuacugcucuaacaucaaacuacaaguggugaaagaugcccaggcucuuuuacaugggcuugacuucucugaagucagcaauguucagcgguugaugcguaaacagaggagagaugacagugaucuaaaacgauugagggauuuaaaucaagccguuaacaaucuugucgagcugaaaucaacucaacagaagaguguacugagaguugggacucuaaccucagaugacuugcuaauuuuggcugccgacuuagagaagcugaaaucaaaagugauuagaacagaaagaccacugagcucagguguuuauaugggcaaccugaguucgcaacaacuugaccaaagacgagcucuccugaauaugauaggaaugagugguggcaaucagggggcucaagucgggagagauggaguggugagaguuugggauguaaagaaugcagaucugcucaacaaucaguuuggcaccaugccaagucugacacuggcauguuuaacaaaacaagggcagguugacuugaaugauguagugcaagcacuaacagauuuaggccugaucuacacagcaaaguauccuaacacuucagacuuggacagauuggcucagagccacccuauuuuaaacaugauagacaccaaaaaaagcucccugaacaucucagguuacaauuuuagcuugggcgcagcugugaaggcaggagccugcaugcuggaugguggcaacauguuagagacaaucaaggugucaccucaaacaauggauggcauccugaaguccaucuugaaagugaaaaaggcucuugggauguucauaucugaaaccccuggcgaaaggaauccuuaugagaacauacucuacaagauuugcuugucaggggauggguggccauauauugcaucaagaaccucaauaacagggagggcuugggaaaacacuaucguugaucuggaaucggaugggaagccacagaaagcugggagcaauaauuccaauaagucccugcagucggcaggauucaccgccgggcuuaccuauucucagcucaugacccucaaagauucaaugcugcagcuugauccaaaugcuaagaccuggauggacauugagggaagaccugaggauccgguggagguugcccuuuaucaaccaaguucaggcugcuacauucacuucuuucgugagccuacugacuugaagcaguuuaagcaagaugcuaaguauucacauggaauugaugucacagaccucuucgcugcacagccagguuugaccagugcuguuauagaggcgcuuccucggaacauggucaucaccugucagggaucugaugacauucgaaagcuccuugaaucacaagggagaaaagauaucaaacuaauugacauugcucucaacaaaacugauuccaggaaguaugagaaugcagucugggaucaguacaaagauuuaugccauaugcacacaggugucguuguugagaagaagaaaagaggugguaaagaggagauaaccccucacugugcccugauggacugcaucauguuugacgcagcagugucagguggacugaaaacacugguucugagagcagugcuacccagagacaugguguucagaacaucgacaccuaaagucguccuguaa

SEQ ID NO: 618 - RNA, 1710 nt, Artificial Sequence
  derived and/or modified CDS sequence (wt) from Lassa virus__AIT17251__NP
augagugccucaaaggagauaaaguccuucuuguggacacaaucuuugaggagggaauugucugguuacugcucuaacaucaaacuacagguggugaaagaugcccaggcucuuuuacaugggcuugacuucucugaggucagcaauguucagcgguugaugcguaaacagaggagagaugacagugaucuaaaacgauugagggauuuaaaucaagccguuaacaaucuugucgagcugaaaucaacucaacagaagaguguacugagaguugggacucuaaccucagaugaccugcuaauuuuggcugccgaccuagagaagcugaaaucaaaagugauuagaacagaaagaccacugagcucagguguuuauaugggcaaccugaguucgcaacaacuugaccaaagacgagcucuccugaauaugauaggaaugagugguggcaaucagggggcucaagucgggagagauggaguggugagaguuugggauguaaagaaugcagaucugcucaacaaucaguuuggcaccaugccaagucugacacuggcauguuuaacaaaacaagggcagguugacuugaaugauguagugcaagcacuaacagauuuaggccugaucuacacagcaaaguauccuaacacuucagacuuggacagauuggcucagagccacccuauuuuaaacaugauagacaccaaaaaaagcucccugaacaucucagguuacaauuuuagcuugggcgcagcugugaaggcaggagccugcaugcuggaugguggcaacauguuagagacaaucaaggugucaccucaaacaauggauggcauccugaaguccaucuugaaagugaaaaaggcucuugggauguucauaucugaaaccccuggcgaaaggaauccuuaugagaacauacucuacaagauuugcuugucaggggauggguggccauauauugcaucaagaaccucaauaacagggagggcuugggaaaacacuauuguugaucuggaaucggaugggaagccacagaaaacugggagcaauaauuccaauaagucccugcagucggcaggauucaccgccgggcuuaccuauucucagcucaugacccucaaagauucaaugcugcagcuugauccaaaugcuaagaccuggauggacauugagggaagaccugaggauccgguggagguugcccuuuaucaaccaaguucaggcugcuacauucacuucuuucgugagccuacugacuugaagcaguuuaagcaagaugcuaaguauucacauggaauugaugucacagaccucuucgcugcacagccagguuugaccagugcuguuauagaggcgcuuccucggaacauggucaucaccugucagggaucugaugacauucgaaagcuccuugaaucacaagggagaaaggauaucaaacuaauugauauugcucucaacaaaacugauucuaggaaguaugagaaugcagucugggaucaguacaaagauuuaugccauaugcacacaggugucguuguugagaagaagaaaagaggcgguaaagaggagauaaccccucacugugcccugauggacugcaucauguuugacgcagcagugucagguggauugaaaacacugguucugagagcagugcuacccagagacaugguguucagaacaucgacacccaaagucguccuguaa

SEQ ID NO: 619 - RNA, 1710 nt, Artificial Sequence
  derived and/or modified CDS sequence (wt) from Lassa virus__AIT17255__NP
augagugccucaaaggaaauaaaguccuuccuguggacacaaucuuugaggagggaauuaucugguuacugcuccaacauuaaacuacagguggugaaagaugcccaagcucuuuugcauggacuugacuucuccgaagucagcaauguucaacgguugaugcguaaagaaagaagggacgacaacgauuugaaacgauugagggaccuaaaucaagcggucaacaaccuuguugaguugaaaucaacucaacaaaagaguguacugagaguugggacucuaaccucagaugacuuauuaguuuuagcugcugaucuagagaaguugaaaucaaaggugaccaggacagaaaggccauugagugcaggugucuauaugggcaaccuaagcucacagcaacuugaccaaagacgagcucuccugaguaugauaggaaugaguggugguaaucaaagggcucaggcugggagagacggaguggugagaguuugggauguaaaaaaugcugaguugcuuaauaaucaguuugggaccaugccaagucuaacacuggcauguuugacaaaacaagggcagguugacuugaacgaugcagugcaagcauugacagauuugggucugaucuacacaguaaaguaucccaaugcuucagacuuggauaggcugacucaaagucacccuauccuaaauaugauugauaccaagaaaagcuccuugaauaucucggguuauaauuucaguuugggugcagcugugaaagcaggagcuugcaugcuagaugguggcaacauguuagagacaaucaaggugucaccucagacaauggauggcauccuuaaguccauuuuaaaggucaagaagacucuugggauguucauuucagauacaccuggugaaaggaauccuuaugaaaacauacucuacaaaauauguuugucaggggauggauggccauauauugcaucaagaaccucaauaacaggaagggcuugggaaaauacuguuguugaucuggaaucaaaugggaagccacagaaagcugacagcaacaguuccaauaaaucucuacagucagcaggguucaccgcugggcuuaccuauucucaacucaugacccucaaggaugcaaugcuacaacuugauccaaaugcuaaaaccuggauggacauugaaggaagaccugaagauccaguggaaauugccuucuaucaaccaaguucaggcuguuacauacacuucuuccgugaaccuacugauuuaaagcaguucaagcaggaugcuaaguauucacaugggauugauguuacagaccucuucgcugcacaaccgggcuugaccagugcuguaauagaugcacucccucggaauauggucauuaccugucagggguccgaugauauaaggaagcuucuugaaucacaaggaagaaaagacauaaaacuaauugauauugcccucagcaaaacugauuccaggaaguaugaaaaugcagucugggaucaguacaaggacuuaugucacaugcacacaggugucguuguugaaaagaagaaaagaggcgguaaagaggagauaaccccucacugugcacuaauggacugcaucauguuugaugcagcagugucaggaggacugaacacauugguuuugagagcagugcuacccagagacaugguguucagaacaucgacaccuagagucguccuguaa

SEQ ID NO: 620 - RNA, 1710 nt, Artificial Sequence
  derived and/or modified CDS sequence (wt) from Lassa virus__AIT17259__NP
augagugccucaaaggaaauaaaauccuuuuuguggacacaauccuugaggagggaauugucuaguuacugcuccaacaucaaacugcagguggugaaagaugcccaggcucuuuuacacggacuugacuucucugaggucaguaauguucaacgguugaugcgcaaggagagaagggaugacaaugauuugaaacgguugagggaccuaaaucaagcggucaacaaucuuguugaauuaaagucaacucaacaaaagaguauacugagaguugggacucuaaccucagaugacuuauuaaucuuggcugcugaucuagagaaguugaagucgaaagugacuagaacagaaaggccauugagugcaggugucuauaugggcaaccugagcucacagcaacuugaccaaaggagagcucuuuugaauauguuaggaaugagugguagcaaucagggggcucgggcuggaagagauggaguggucagaguuugggaugugaaaaaugcagaguugcucaauaaucaguucgggaccaugccaagucugacacuggcaugucugacaaaacaggggcagguugacuugaaugaugcaguacaagcauugacagauuuagguuugaucuacacagcgaaguaucccaauacuucggacuuagacagacugacucaaagucaccccauccuaaauaugauugacaccaagaaaagcuccuugaauaucucagguuauaauuuuagcuugggugcagcugugaaagcaggagcuuguaugcuggaugguggcaauauguuggagacaaucaaggugucaccucagacaauggaugguauucucaaauccauuuugaaggucaagaaagcucuugggauguucauuucagauaccccuggugaaaggaacccuuacgagaacauacucuacaagauuugcuugucaggagauggcuggccauacauugcaucaagaaccucaauaacaggaagggccugggaaaacacuguuguugaucuggaaucagaugggaagccacagaaagcuggcagcaacaguuccaacaaaucucugcagucggcaggauuuaccgcugggcuuaccuauucucagcugaugacccucaaggaugcaaugcugcaacuugacccaaaugccaagaccuggauggacaucgaaggaagaccugaagauccaguagaaaucgcccucuaucaaccaaguucggggugcuacauacauuucuuccgugaaccuacugaucuaaagcaguucaagcaggaugcuaaguacucacaugggauugaugucacggaucucuucgcugcacaaccgggcuugaccagugcugucauugaugcacucccccggaauauggucaucaccugccaggggucugaugacauaaggaaacuccuugaaucacaagggagaaaggacaucaaacuaauugacauugcccucagcaagacugauuccaggaaguaugaaaaugcagucugggaucaguauaaagacuuaugccacaugcacacagguauuguuguugagaagaagaaaagaggcgguaaagaggaaauaaccccucacugugcacuaauggauugcauuauguuugaugcagcagugucaggaggacugaacgcaucgguuuugagagcagugcugcccagagauaugguguucagaacaucgacaccuagagucguccuguaa

SEQ ID NO: 621 - RNA, 1710 nt, Artificial Sequence
  derived and/or modified CDS sequence (wt) from Lassa virus__AIT17263__NP
augagugccucaaaggaaauaaaauccuuuuuguggacacaauccuugaggagggaauuaucuggcuacugcuccaacaucaaacugcagguggucaaagaugcccaggcucuuuuacauggacuugacuucucugaaguuaguaauguucaacgguugaugcgcaaggagagaagggaugacaaugauuugaaacgguuaagggacuugaaucaagcggucaacaaucuugucgaauuaaaaucaacucaacaaaagaguguacugagaguugggacucuaaccucagaugacuuauuaaucuuggccgcugaucuagagaaguugaagucgaaggugaucagaacagaaaggccguugagugcaggugucuauauggguaaccugagcucacagcaacuugaccaaagaagggcucuucugaauaugauaggaaugggugguaguaaucaaggggcucgggcugggagagauggaguggucagaguuugggaugugaaaaaugcagaguugcucaauaaucaguucgggaccaugccaaguuugacacuggcaugucugacaaaacaggggcagguugacuugaaugaugcaguacaagcauugacagauuuagguuugaucuacacagcgaaguaucccaauacuucagacuuagacaggcugacucaaagucaccccauccuaaauaugauugacaccaagaaaagcucuuugaacaucucagguuauaauuuuagcuugggugcagcugugaaggcaggagccuguaugcuggaugguggcaauauguuggaaacaaucaaggugucaccucagacaauggaugguauucucaaguccauuuuaaaggucaagaaggcucuugggauguucauuucagauaccccuggugaaaggaauccuuaugaaaacauacucuacaagauuuguuugucaggagauggcuggccauacauugcaucaagaaccucaauaacaggaagggccugggaaaacacuguuguugaucuggaaucagaugggaagccacagaaagcuggcagcaaugguuccaauaaaucucugcagucggcaggauuuaccgcugggcuuaccuauucucagcugaugacccucaaggaugcaaugcugcaacuugacccaaauacuaagaccuggauggacauugaaggaagaccugaagacccaguggaagucgcccucuaucaaccaaguucaggaugcuauauacacuucuuccgugagccuacugauuuaaagcaguucaaacaagaugcuaaguacucacaugggauugaugucacggaccucuuugcugcacaaccggguuugaccagugcugucauugaugcacucccccggaacauggucaucaccugccaggggucugaugacauaaggaaacuccuugaaucacagggaaggaaagacaucaaacugauugacauugcccucagcaagacugauuccaggaaguaugaaaaugcagucugggaccaguauaaagacuuaugccacaugcacacagguauuguuguugagaagaagaaaagaggcgguaaagaggaaauaacuccucacugugcauuaauggacugcaucauguuugaugcagcagugucaggaggacugaacacaucgguuuugagagcagugcugccuagagauaugguguucagaacaucgacaccuagagucguccuguaa

SEQ ID NO: 622 - RNA, 1710 nt, Artificial Sequence
  derived and/or modified CDS sequence (wt) from Lassa virus__AIT17267__NP
augagugccucaaaggaaauaaaauccuuuuuguggacacaaucuuugaggagggaguuaucugguuacuguuccaacaucaaacuacagguggugaaagaugcucaggcccuuuugcauggacuugacuuuuccgaagucaguaauguucaacgguugaugcgcaaggagaggagggaugacaaugauuugaaacgguugagagaccugaaucaagcggugaacaaucuuguugaauuaaaaucaacucaacaaaagaguguacugaggguugggacucuaaccucagaugacuuguuaaucuuggccgcugaucuagagaaguugaagucaaaggugaccagaacagaaaggccacugagugcaggugucuauaugggcaaccuaagcucacagcaacuugaccaaagaagagcucuucugaauaugauagggaugagugguggcaaucaaggggcucgggcugggagagauggagugguaagaguuugggaugugaagaaugcagaguugcucaauaaucaguucggaaccaugccaagccugacacuggcaugucugacaaaacaggggcagguugacuugaaugaugcaguacaggcacugacagauuuggguuugaucuacacagcaaaguaucccaauacuucagacuuagacaggcugacucaaagucaccccauccuaaauaugauugacaccaagaaaagcucuuugaauaucucagguuauaauuuuagcuugggugcagcugugaaggcaggagccugcaugcuggaugguggcaacauguuggagacaaucaaagugucaccucagacaauggauaguauccucaaauccauuuuaaaagucaaaaaggcucuagggauguucauuucagacaccccuggugaaaggaauccuuaugaaaacauacucuacaagauuuguuuaucaggagauggauggccauauauugcaucaagaaccucaauaacaggaagggccugggaaaacacuguuguugaucuggaaucagaugggaagccacagaaagcuggcagcaacaauuccaauaaaucccugcagucggcgggguuugcagcugggcucaccuauucucagcugaugacccucaaggaugcaaugcugcaacuugacccaaaugcuaagaccuggauggacauugaaggaagaccugaagauccaguggaaauagcccucuaucaaccaaguucaggcugcuacauacacuucuuccgugaaccuacugauuuaaagcaguucaagcaggaugcuaaguacucacaugggauugaugucacagaccucuuugcugcacaaccuggccugaccagugcugucauugaugcacucccccggaauauggucauuaccugucagggaucugaugacauaagaaaacuccuugaaucacaaggaagaaaagacaucaaauuaauugauauugcccucagcaagacugauuccaggaaguaugaaaaugcagucugggaucaauauaaagaccuaugccacaugcacacagguguuguuguugagaagaagaaaagaggcgguaaagaggaaauaaccccucacugugcacuaauggacugcaucauguuugaugcagcagugucaggggggcugaacacaucaguuuugagagcagugcugcccagagauaugguguucagaacaacgacaccuagagucguccuguaa

SEQ ID NO: 623 - RNA, 1710 nt, Artificial Sequence
  derived and/or modified CDS sequence (wt) from Lassa virus__AIT17271__NP
augagugccucaaaggaaauaaagucuuuucuguggacacaaucauugaggagggaauuaucugguuauugcuccaacaucaaacuacagguggugaaagaugcccaagcucucuuacacggacuugacuucuccgaaguuaguaauguucaacgguugaugcgcaaggagagaagggaugacaaugacuugaaacgguugagggacuuaaaucaagcagucaacaaccuuguugagcuaaagucaacucaacaaaagagcauacugagaguugggacucuaacuucagaugacuuauuaaucuuagccgcugaccuggagaaguugaaaucaaaggugaccaggacagaaaggccacugagugcaggugucuauaugggcaaccuaagcucacagcaacuugaccaaagacgagcucuucugaauaugauaggaaugaguggugguaaucaaggggcucgggcuggaagagacggaguggugagaguuugggacgugaaaaaugcagaguugcuuaauaaucaguucggaaccaugccaaguuuaacacuggcaugucugacaaaacaggggcagguugacuugaaugaugcagugcaagcauugacagacuuggguuugaucuacacagcaaaguaucccaauacuucagacuuagacaggcugacucaaagucacccuauccuaaacaugauugacaccaagaaaagcucucugaauaucucagguuauaauuuuagcuugggugcagcuguaaaggcaggagcuugcaugcuggaugguggcaauauguuggagacaaucaagguuucaccucagacaauggaugguauccuaaaaaccauccuaaaggucaagaaggcucuugggauguucaucucagacaccccuggugaaaggaauccuuacgagaacauacucuacaagauuugccuaucaggagauggauggccauacauugcaucaagaaccucaauaacaggaagggccugggaaaacacugucguugaucuggaaucagaugggaaaccacagaaaacuggcagcaacaauuccaauaaaucccugcagucggcaggguuugccgcugggcuuacuuauucucagcugaugacccucaaggaugcaaugcugcaacuugacccaaaugcuaagaccuggauggauauugaaggaagaccugaggauccaguggaaauugcccuuuaucagccaaguucaggcugcuacauacacuucuuccgugaaccuacugacuuaaagcaguucaagcaggaugcuaaguacucacaugggauugauguuacagaccucuuugcugcacaaccgggcuuaaccagugcuguuauagaugcacucccucggaauauggucauuaccugucagggaucugaugacauaaggaaacuccuugaaucacaagguagaaaagacaucaaacuaauugauauugcccucagcaaggcugauuccaggaaguaugaaaaugcaguuugggaucaguauaaagacuuaugucacaugcacacagguguuguuguugaaaagaagaagcgaggugguaaagaggaaauaacuccccacugcgcacuaauggacugcaucauguaugaugcagcagugucaggaggacugagcacaucgguuuuaagagcaguacuacccagagauaugguguucagaacaucaacaccuagagucguccuguaa

SEQ ID NO: 624 - RNA, 1710 nt, Artificial Sequence
  derived and/or modified CDS sequence (wt) from Lassa virus__AIT17275__NP
augagcgccucaaaggagauaaaguccuucuuguggacacaaucuuugaggagggaacugucugguuauuguuccaauauuaaacuacagguggugaaggaugcccaagcucuuuuacauggacucgauuucucugagguuagcaauguucagcgauugaugcgcaaacagagaagggaugauggugaucuaaaaagguugagggaucuuaaucaagcagucaacaaccuuguugaguugaaaucaacucaacaaaaaaguguguugagaguugggacuuugaccucagaugaccugcugacuuuggcugcugaccuagagaaacuuaaaucaaaaguaaccaggacagaaaggccauugagugcaggaguuuauaugggcaacuugaguucacaacaacuugaccagagacgggcucuccuaaacaugauaggaaugagcggugguaaucaaggggcucggaccgggaaagauggaguggugagaauuugggauguaaaaaaugcggacuugcuuaacaaucaguucggcaccaugccaagucuaacacuggcauguuuaacaaaacaggggcagguugaccugaaugauguugugcaagcgcuaacagauuugggucugaucuacacagcaaaauaccccaacauuucagacuuagacagacuggcucagagccaccccauucuaaaaaugauagacaccagcaaaagcucccugaacauuucugguuacaauuuuagucugggugcagcuguaaaggcaggagcuugcaugcuagacggugguaacaugcuggagacagucaaggugucgccucagacaauggauggcauccucaaguccauucuaaaggucaaaaagagucuugggauguucauaucagacaccccuggcgaaaggaauccuuaugaaaauauacucuacaagaucugucugucaggagauggauggccguauauugcaucaagaacuucaauaacaggaagggccugggaaaacacugucguugauuuggagucagaugggaagccacaaaaaguugggagcaacaacuccaacaaaucccuacagucaacaggguuuacugccgggcuuaccuauucucagcuuaugacucuuaaagaugcaauguugcaacuugauccaaaugcuaagaccuggauggacauugaagggagaccugaagauccgguggaaauugcuuuguaucagccaaguucaggcugcuacauucacuucuuccgugagccuacugauuuaaagcaguuuaagcaagaugccaaguacucacauggaauugaugugacagaccucuucgcugcacaaccaggcuuaacuagugcuguuauagacacacucccccggaauauggucauuaccugucaggggucugaugacauagggaaacuccuugaaucacaaggaagaaaagauaucaaacuaauugacauugcccucaguaaaacugauucuaggaaauaugaaaaugcagucugggaccaguauaaagacuuaugccauaugcacacagguguugucguugagaagaagaaaagaggugguaaggaggaaauaaccccucacugugcucuaauggacuguauuauguuugaugcagcaguuucaggagggcugaacgcaucaguucugagagcugugcugccuagagacaugguguuuagaacaucgacaccaagagucguccuguaa

SEQ ID NO: 625 - RNA, 1710 nt, Artificial Sequence
  derived and/or modified CDS sequence (wt) from Lassa virus__AIT17277__NP
augagugcuucaaaggaaauaaaguccuuucuguggacacaaucauuaaggagggaauuaucuaguuacuguuccaacaucaaacuacagguggugaaagaugcccaggcucuuuugcaugggcuugacuucuccgaagucagcaauguucaacgguugaugcgcaaggagagaagggaugacaaugauuuaaagcgguugagggaccuuaaucaagcggucaacaaccuuguugaguuaaaaucaacucaacaaaagaguauauugagaguugggaccuuaaccucagaugacuuacuaaucuuagcugcugaucuagagaagcugaaaucaaaggugacuaggacagaaaggccauugagugcaggugucuacauggguaaccugagcucacagcaacuugaccagagacgagcucuucugagcaugauagggaugagugguaguaaucaaggggcucgggcugggagagauggaguggugagaguuugggaugugaaaaaugcagaguugcucaauaaucaguucgggaccaugccaagucuuacacuggcauguuugacaaaacaggggcagguugacuugaaugaugcagugcaagcauugacagauuugggucugaucuacacggcaaaguaucccaauacuucagaccuggauaggcugacucaaagucaccccauccuaaacaugauugacaccaagaagagcucuuuaaacaucucagguuauaauuuuagcuugggugcagcugugaaggcaggagcuugcaugcuggaugguggcaacauguuggagacaaucaaggugucaccucagacaauggaugguauccucaaauccaucuugaaggucaagaaggcucuugggauguucaucucagacaccccuggugaaaggaauccuuaugagaacauacucuauaagaucugucugucaggagauggguggccauacauugcaucaaggaccucaauaacaggaagggcuugggaaaacacugucguugaucuggaaucagaugggaagccacagaaagcuggcagcaacaauucuaacaaaucccugcagucggcaggguuuaccgcugggcuuaccuauucucagcuaaugacucucaaggaugcaaugcugcaacuugauccaaaugcuaagaccuggauggauauugaaggaagaccugaagauccaguggaaguugcccucuaucaaccaaguucaggcuguuacauucacuucuuccgugaaccuacugauuuaaagcaguucaaacaggaugcuaaguacucacaugggauugaugucacagaccucuucgcugcacaaccgggccugaccagugcugucauagaugcacucccucggaauauggucauuaccugucagggguccgaugacauaaggaaacuccuugaaucacaagguaggaaagacaucaaacuaauugauauugcccucagcaaaacugauuccaggaaguaugaaaaugcagucugggaucaguauaaagacuuaugccacaugcacacaggugucguuguugagaagaagaaaagaggugguaaagaggaaauaaccccucacugugcacuaauggacugcaucauguuugacgcagcagugucaggaggacugaacacaucgguuuugagagcagugcuacccagggauaugguguucagaacaucaacaccuagagucguucuguaa

SEQ ID NO: 626 - RNA, 1710 nt, Artificial Sequence
  derived and/or modified CDS sequence (wt) from Lassa virus__AIT17281__NP
augagugccucaaaagaaauaaaguccuuuuuguggacacaaucuuugaggagggaacuaucuggcuacugcucuaacaucaaacuucagguggugaaagaugcucaggcucuuuugcauggacuugacuucuccgaggucagcaauguucagcgguugaugcgcaaagagaggagggaugacagugaccugaaacgguugagggaccugaaccaagcggucaacaaccuuguugaguuaaaaucaacucaacaaaagagugugcugagaguugggacucuaaccucagaugacuuauuagucuuagcugcugaucuagagaagcugaaaucaaaggugaccagaacagaaaggccauugagcgcaggugucuauaugggcaaccugagcucacagcaacuugaccaaagacgagcucuucugagcaugauaggaaugaguggugguaaucaaggagcucgggcugggagagauggaguggugagaauuugggauguuaaaaaugcagaguugcuuaauaaucaguucgggaccaugccaagucugacacuggcauguuugacaaaacaagggcagguugacuuaaaugaugucgugcaagcauugacagauuuggguuugaucuacacagcaaaguaccccaacacuucagacuuggacaggcugacucaaagucaccccauccuaaauaugauugacaccaagaaaagcucuuugaauaucucagguuauaauuuuaguuugggugcagcugugaaggcaggagcuugcaugcuagaugguggcaauauguuggagacaaucaaggugucaccucagacaauggaugguauccucaaauccauuuuaaaggucaagaaggcucucgggauguucauuucagacacuccuggugagaggaauccuuaugaaaacauacucuauaagauuuguuugucaggggauggauggccauauauugcaucaagaacuucaauaacaggaagggccugggaaaacacuaucguugaucuggagucggaugggaagccacagaagacuaguaccaccaauuccaacaaaucccugcagucggcaggguuugccgcugggcuaacauauucucagcuuaugacccucaaggaugcaaugcugcaacuugacccaaaugccaagaccuggauggacauugaagggagacccgaagauccaguagaaauugcccucuaucaaccaaguucaggcugcuacauacacuucuuccgugagccuacugauuugaagcaguucaagcaggaugcuaaauacucacaugggauugaugucacagaccuuuuugcugcacaaccaggccugaccagugcuguuauagauacacucccccggaacauggucauuaccugucagggguccgaagacauuaggagacuccuugaaucacaaggaagaaaagacaucaaacuaauugauauugcccucagcaagacugauuccaggaaguaugagaaugcagucugggaucaguauaaagauuuaugccacaugcacacaggugucguuguugaaaagaagaagaagggcgguaaagaggaaauaacuccccacugugcacuaauggauugcaucauguuugacgcagcagugucaggaggacugaacacaucaguuuugagagcagugcuacccagagacaugguguucagaacaucaacaccuagagucguccuguaa

SEQ ID NO: 627 - RNA, 1710 nt, Artificial Sequence
  derived and/or modified CDS sequence (wt) from Lassa virus__AIT17285__NP
augagugccucaaaggaaauaaaauccuuuuuguggacacaaucuuugaggagggaauuaucugguuacugcuccaacauaaagcugcagguggugaaagaugcccaggcucuuuuacauggacuugauuucucugaagucagcaauguucaacggucgaugcgcaaggagaggagggaugacaaugauuugaaacgguugagggaucuaaaucaagcggucaacaaucuuguugaauuaaaaucaacccaacaaaagaguauacugagaguugggacucuaaccucagaugacuuacuaaucuuggccgcugauuuagagaaauugaagucgaaggugaccagaacagaaaggccauugagugcaggugucuauaugggcaaccuaagcucacagcaacuugaccaaagaagagcucuucugaacaugauaggaaugagugguaguaaucaaggggcucgggcugggagagauggaguggucagaguuugggaugugaaaaaugcagaguugcucaauaaucaguucgggaccaugccaagucugacacuggcaugucugacaaaacaggggcagguugaccugaaugauguaguacaagcauugacagauuuggguuugaucuacacagcaaaguauccaaaugcuucagacuuggacaggcugacucaaagucaccccauccuaaauaugauugacaccaaaaaaagcucuuugaauaucucagguuauaauuuuagcuugggugcagcugugaaggcaggagcuuguaugcuggaugguggcaauauguuggagacaaucaaggugucaccucagacaauggaugguauucucaaauccauuuuaaagguuaaaaaggcucuugggauguucauuucagacaccccuggugaacggaauccuuaugaaaacauacucuacaagauuugcuugucaggagauggauggccauacauugcaucaagaaccucaauaacaggaagggccugggaaaacacuauuguugaucuggagucagaugggaagccacagaaagcuggcaacaacgguuccaauaaaucucugcaaucggcaggauuuaccgcugggcuuaccuauucucagcugaugacccucaaggaugcaaugcugcaacuugacccaaaugcuaagaccuggauggacauugaaggaagaccugaagauccaguggagaucgcccucuaucaaccaaguucaggaugcuacauacacuucuuccgugaaccuacugacuuaaagcaauucaagcaagaugcuaaguacucacaugggauugaugucacagaucucuucgcugcacaaccgggcuugaccagugcugucauugaugcacucccccggaauuugguuaucaccugccaggggucugaugauauaaggaaacuccuugaaucacaaggaagaaaagacaucaaacuaauugacauugcccucagcaagacugauuccaggaaguaugaaaaugcagucugggaucaguacaaagaccuaugccacaugcacacagguauuguuguugagaagaagaaaagaggcggcaaagaggagauaaccccucacugugcacuaauggacugcaucauguuugaugcagcggugucaggaggacugaacacaucaguuuugagagcagugcugcccagagauaugguguuuagaacaucaacaccuagggucguccuguaa

SEQ ID NO: 628 - RNA, 1710 nt, Artificial Sequence
  derived and/or modified CDS sequence (wt) from Lassa virus__AIT17289__NP
augagugccucaaaagaaauaaaguccuuuuuguggacacaaucuuugaggagggaauuauccgguuacugcuccaacaucaaacuucagguggugaaagaugcucaggcucuuuugcaugggcuugacuucuccgaagucaguaauguucaacgguugaugcgcaaagagagaagggaugacagugaucugaaacgguugagggaccugaaccaagcggucaacaaccuuguugaguuaaaaucaacucaacaaaagaguguacugagaguugggacucuaaccucagaugacuuguuaguccuagcugcugaucuagaaaaguugaaaucaaaagugaccaggacagagaggccauugagcgcaggugucuauaugggcaaccuaagcucacagcaacuugaccaaagacgagcucuucugagcaugauaggaaugaguggugguaaucaaggaguccgggcugggagagauggaguaguaagaauuugggauguaaaaaaugcagaguugcucaauaaucaguucgggaccaugccaagucugacacuggcauguuugacaaaacaaggacagguugacuuaaaugauguagugcaagcauugacagauuuggguuugaucuacacagcaaaguaccccaacacuucagacuuggauaggcugacucaaagucaccccauccuaaauaugauugacaccaagaaaagcucucugaauaucucagguuauaauuuuaguuugggugcagcugugaaggcaggggcuugcaugcuggauggugguaacauguuggagacaaucaaggugucaccucagacaauggaugguauccucaaauccauuuuaaaggucaagaaggcucucgggauguucaucucagacacuccuggugagaggaauccuuaugaaaacauacucuauaagauuuguuugucaggggauggauggccauauauugcaucaagaaccucaauaacaggaagagccugggaaaacacuaucguugaucuagaaucagaugggaagccacagaaaacuggcagcaucaauuccaacaaaucccugcagucgacaggguuugcugcugggcuuaccuauucucagcuuaugacccucaaggaugcgaugcugcaacuugacccaaaugcuaagaccuggauggacauugaaggaagaccugaagauccaguagaaauugcccucuaccaaccaaguucaggcugcuauauacacuucuuccgugagccuacugauuuaaagcaguucaagcaggaugcuaaauacucacaugggauugaugucacagaccucuucgcugcacaaccgggcuugaccagugcuguuauagaugcacucccccggaauauggucauuaccugucagggguccgaugacauuaggaaacuccuugaaucacaaggaagaaaggacaucaaacuaauugauauugcccucagcaaaacugauuccaggaaguaugagaaugcagucugggaucaguauaaagacuuaugccauaugcacacaggcaucguuguugaaaagaagaaaaggggcggcaaagaggaaauaacuccucacugugcacuaauggauuguaucauguuugaugcagcagugucaggaggacugaacacaucaguuuugagagcagugcuacccagagacaugguguucagaacaucaacaccuagagucguccuguaa

SEQ ID NO: 629 - RNA, 1710 nt, Artificial Sequence
  derived and/or modified CDS sequence (wt) from Lassa virus__AIT17293__NP
augagugccucaaaagagauaaaguccuuccuguggacacaaucuuugaggagagaauugucugguuauugcuccaacaucaaacuacagguggugaaagaugcccaagcucuuuugcaugggcuugacuucucugaggucaguaauguucaacggcugaugcgcaaacagagaagagaugacaaugaucugaaacgauuaagggaucuaaaucaggcagucaacaaucuuguugagcugaaaucaacucaacagaagagugugcugagaguugggacucugacuucagaugacuuauuaguucuggcugcugaccuagagaaauugaagucaaaaguuaccagaacagagaggccauugagugcagguguuuauaugggcaacuuaagcacacaacagcuagaucagaggcgagcucuucugaacaugauagggaugaguggugguaaucaaggggcccgggcugguagagauggaguggugagagucugggaugugaaaaaugccgaccuacuuaauaaucaauuuggcaccaugccaagucugacacuggcauguuuaacgaagcaggggcagguugacuugaaugauguggugcaagcauugacagauuugggcuugaucuacacagcaaaguacccuaacaccuccgacuuagacaggcuaacucagagccaccccauccugaacaugauugacaccaauaaaaguuccuugaacaucucagguuauaauuuuagcuugggugcggcugugaaggcaggagcuugcauguuggauggugguaacaugcuggagacaaucaaggugucaccucagacaauggauggcauccucaaguccauucuaaaggucaagaaggcucuugggauguucaucucagacaccccuggugaaaggaacccuuaugaaaauauacuuuacaaaauuugcuugucaggggauggauggccguauauugcaucaagaacuucuauaacaggaagggccugggaaaacacugucguugauuuggaaucagacgggaaaccacagaaagcugggggcaacaacuccaacaaaucccuacagucggcaggguucacugcugggcucacuuauucucagcuuaugacccucaaagaugcaaugcugcaacuugauccaaaugccaagaccuggauggacauugagggaaggcccgaagauccaguggaaauugcccucuaucagccaaguucagguuguuacauucacuucuuccgugaacccacugauuuaaagcaguucaaacaagaugcuaaguauucacauggaauugauguuacagaccucuucgcugcacaaccagguuuaacuagugcugucauagaugcacucccccggaauauggucauuacuugucagggaucugaugacauaaggaaacuccuagaaucacagggaagaaaggauaucaaacucauugacauugcccucagcaaaacugauucuaggaaguaugaaaaugcagucugggaucaguauaaagaccuaugcaauaugcacacaggaaucguuguugaaaagaagaaaagaggugguaaagaggaaauaaccccucacugugcccuaauggacugcauuauguuugaugcagcagugucaggaggaaugaacacaucaguuuugagagcagugcuaccuagagacaugguguucagaacaucaacaccaagggucguccuguaa

SEQ ID NO: 630 - RNA, 1710 nt, Artificial Sequence
  derived and/or modified CDS sequence (wt) from Lassa virus__AIT17295__NP
augagugccucaaaggaaauaaaaucuuuuuuguggacacaauccuugaggagggaauuaucugguuacugcuccaacaucaaacugcagguggucaaagaugcccaggcucuuuuacauggacuugacuucucugaaguuaguaauguucaacgguugaugcgcaaggagagaagggaugacaaugauuugaaacgguugagggacuugaaucaagcggucaacaaucuuguugaauuaaaaucaacucaacaaaagaguguacugagaguugggacucuaaccucagaugacuuauuaaucuuggccgcugaucuagagaaguugaagucgaaggugaucagaacagaaaggccauugagugcaggugucuauaugggcaaccuaagcucacagcaacuugaccaaagaagggcucuucuaaauaugauaggaaugggugguaguaaucaaggggcucgggcugggagagauggaguggucagaguuugggaugugaaaaaugcagaguugcucaauaaucaguucgggaccaugccaaguuugacacuggcaugucugacaaaacaggggcagguugacuugaaugaugcaguacaagcauugacggauuuagguuugaucuacacagcgaaguaucccaauacuucagacuuagacaggcugacucaaagucaccccauccuaaauaugauugacaccaagaaaagcucuuugaacaucucagguuauaauuuuagcuugggugcagcugugaaggcaggagcuugcaugcuggaugguggcaauauguuggagacaaucaaggugucaccucagacaauggaugguauucucaaguccauuuuaaaggucaagaaggcucuugggauguucauuucagauaccccuggugaaaggaauccuuaugaaaacauacucuacaagauuuguuugucaggagauggcuggccauacauugcaucaagaaccucaauaacaggaagggccugggaaaacaccauuguugaucuggaaucagaugggaagccacagaaagcuggcagcaaugguuccaauaaaucucugcagucggcaggauuuaccgcugggcuuaccuauucucagcugaugacccucaaggaugcaaugcugcaacuugacccaaaugcuaagaccuggauggacauugaaggaagaccugaagacccaguggaaauugcccucuaucaaccaaguucaggaugcuauauacacuucuuccgugaaccuacugauuuaaagcaguucaagcaagaugcuaaguacucacaugggauugaugucacggaccucuuugcugcacaaccggguuugaccagugcuaucauugaugcacucccccggaacauggucaucaccugccaggggucugaugacauaaggaaacuccuugaaucacagggaaggaaagacaucaaacugauugacauugcccucagcaagacugauuccagaaaguaugaaaaugcagucugggaucaguauaaagacuuaugccacaugcacacagguauuguuguugagaagaagaaaagaggcgguaaagaggaaauaacuccucacugugcacuaauggacugcaucauguuugaugcagcaguaucaggaggacugaacacaucgguuuugagagcagugcuacccagagauaugguuuucagaacaucgacaccuagagucguccuguaa

SEQ ID NO: 631 - RNA, 1710 nt, Artificial Sequence
  derived and/or modified CDS sequence (wt) from Lassa virus__AIT17299__NP
augagugccucaaaggaaauaaaguccuuucuguggacacaauccuuaaggagagaacuaucugguuacugcuccaacaucaaacuucagguggugaaagaugcccaagcucuuuugcacggacuugacuucuccgaggucagcaauguccaacgguugaugcgcaaagagagaagggaugacaaugacuugaaacggcugagggaccuaaaucaagcggucaacaaccuuguugaguuaaaaucaacucaacagaagaguguacugagaguugggacccuaaccucagaugacuuauuaguguuagcugcugaucuagagaaguugaaaucaaaagugaccaggacagaaagaccauugagugcaggugucuauaugggcaacuugagcucacagcaacuugaccaaaggagagcucuucugaguaugauagggaugagugguggcaaccaaggggcucggacugggagagaugggguggugagaguuugggauguaaaaaaugcagaguugcucaauaaucaguucgggaccaugccaagucugacacuggcauguuuaacaaaacaagggcagguugacuuaaaugauguaguacaagcacugacagauuugggucugaucuacacagcaaaauaucccaacacuucagaccuggauaggcugacucaaagucaccccauccuaaauaugauugacaccaagaaaagcucuuugaauaucucagguuauaauuuuagcuugggugcagcugugaaagcaggagcuuguaugcuggaugguggcaauauguuggagacaaucaaagugucaccucagacaauggauggcauccuuaaauccauuuuaaaggucaagaaggcucuugggauguucaucucagacaccccuggugaaaggaaucccuacgagaauauacucuacaaaauuuguuugucaggggauggauggccauauauugcgucaagaaccucaauaacaggaagggccugggaaaacacugucguugaucuagaaucagaugggaagccacagaaagcuggcagcaacaauuccaacaaaucccugcaaucggcaggguuuaccgcugggcucacuuauucucagcuuaugacccucaaggaugcaaugcugcaacuugauccgaaugcuaagaccuggauggacauugaaggaagaccugaagauccaguugaaauugcccuuuaucaaccaaguucaggcugcuacauacacuucuuccgugagcccagugauuuaaagcaguucaagcaagaugcuaaauacucacaugggauugaugucacagaccucuucgcugcacaaccgggcuugacuagugcugucauagaugcacucccccggaauauggucauuaccugucagggguccgaugauauaaggaaacucuuugaaucacaaggaagaaaggacaucaaauuaauugauauugcccucagcaaaacugacuccaggaaguaugagaaugcagucugggaucaguauaaagacuuaugccacaugcacacaggugucguuguugaaaagaagaaaagaggcgguaaagaggaaauaaccccucacugugcacuaauggacugcaucauguuugaugcagcagugucaggaggacugaacucauugguuuugagagcagugcugcccagagacaugguguucagaacaucgacaccuagagucguccuguaa

SEQ ID NO: 632 - RNA, 1710 nt, Artificial Sequence
  derived and/or modified CDS sequence (wt) from Lassa virus__AIT17303__NP
augagugccucaaaggagauaaaguccuuccuguggacacaaucuuugaggagggaauugucugguuacuguuccaacaucaaauuacagguggugaaagaugcucaggcucuuuuacauggacuugacuucucugaagucagcaauguucagcgguugaugcguaaacagaggagagaugacagugaucuaaaacgauugagggauuuaaaucaagccguuaauaaucuugucgagcugaaaucaacucaacagaagaguguauugagaguugggacucuaaccucagaugacuuguuaguuuuggcugcugaccuagagaagcugaaaucaaaagugaucagaacagaaagaccacuaagcucagguguuuauaugggcaaccuaaguucgcaacaacucgaccaaagacgagcucuccugaauaugauaggaaugagugguggcaaucagggggcucaaguugggagagaugggguggugagaguuugggauguaaagaaugcagauuugcucaacaaucaguuuggcaccaugccaagucugacacuggcauguuuaacaaagcaagggcagguugacuugaaugauguagugcaagcacuaacagauuuaggccugaucuacacagcaaaguauccuaacacuucagacuuggacagauugguucagagccacccuauucugaacaugauagacaccaagaaaagcucccugaacaucucagguuacaauuuuagcuugggcgcagcugugaaggcaggggccugcaugcuagauggugguaacauguuagagacaaucaaggugucaccucaaacaauggauggcauccugaaguccaucuugaaagugaaaaaggcucuugggauguucauaucugaaaccccuggcgaaaggaauccuuaugagaacauacucuacaagauuuguuugucaggagauggguggccauauauugcaucaagaaccucaauaacagggagggcuugggaaaacacuauuguugaucuggaaucggaugggaagccacagaaagcugggagcaacaauuccaauaagucccugcaaucggcaggauucaccgccgggcucaccuauucucagcucaugacccucaaagauucaaugcugcagcuugauccaaaugcuaagaccuggauggacauugagggaagaccugaggauccgguggagguugcccuuuaucaaccaaguucaggcuguuacauucacuucuuucgugagccuacugacuugaagcaguuuaagcaagaugcuaaguauucacauggaauugaugucacagaccucuucgcugcacagccaggcuuaaccagugcuguuauagaggcgcuuccucggaacauggucaucaccugucagggaucugaugacauucgaaagcuccuugaaucacaagggaggaaggauaucaaacuaauugacauugcucucaacaagacugauucuaggaaguaugagaaugcagucugggaucaguacaaagacuuaugccauaugcacacaggugucguuguugagaagaagaaaagaggugguaaagaggagauaaccccucacugugcccugauggacugcaucauguuugacgcagcagugucagguggauugaaaacacugguucugagagcagugcuacccagagacaugguguuuagaacaucgacacccaaagucguccuguaa

SEQ ID NO: 633 - RNA, 1710 nt, Artificial Sequence
  derived and/or modified CDS sequence (wt) from Lassa virus__AIT17307__NP
augagugccucaaaggaaauaaaguccuuucucuggacacaaucauugagaagggaacuaucugguuacugcuccaacaucaaacuacagguugugaaagaugcccaagcucuuuuacauggacuugauuucuccgaagucagcaauguucaacggcugaugcgcaaggagagaagggaugacaaugaucugaaacgguugagggaccuaaaucaagcggucaacaaccuuguugaguuaaaaucaacucaacaaaagaguguacugagaguugggacucuaacaucagaugacuuauuaaucuuggccgcugaucuagagaaguugaaaucaaaggugaccaggacagaaaggccauugagugcaggugucuauaugggcaaccugagcucacagcaacuugaccagagacgagcucuucugaguaugauaggaaugaguggugguaaucaaggggcucggacugggagagauggaguggugagaguuugggaugugaaaaaugcagaguugcuuaacaaucaguucgggaccaugccaaguuugacacuggcaugucugacaaagcaggggcagguugaccugaaugauguagugcaagcauugacagauuugggucugaucuacacagcuaaguaucccaauacuucagacuuagauaggcugacucagagucaccccauccuaaacaugauugacaccaagaaaagcucucugaauaucucaggcuauaauuucagccugggugcagcugugaaggcaggagcuugcaugcuagauggcggcaacaugcuagagacaauuaaggugucaccucagacgauggacggcauccucaaauccaucuuaaaggucaagaaggcucuugggauguucaucucagacaccccuggugaaaggaauccuuaugaaaacauacucuacaagaucuguuugucaggagauggauggccauauauugcaucaagaaccucaauaacaggaagggccugggaaaacacugucguugaucuggaaucagaugggaagcuacagaaaacuggcagcaacaauuccaacaaauccuugcagucggcaggguuuaccgcugggcuuaccuauucucagcuaaugacccucaaggaugcaauguugcaacuugacccaaaugccaagaucuggauggacauugaaggaagaccugaagauccaguggagauugcccucuaucaaccaaguucaggcugcuacauacacuucuuccgugagccuacugacuuaaagcaguucaagcaggaugcuaaguacucacaugggauugauguuacggaccucuucgcugcacagccggguuugaccagugcugucauugaugcacucccccggaauauggucauuaccugucagggguccgaugacauaaggaaacuccuugaaucacaagguagaaaagacaucaaacuaauugauauugcccucaacaaaacugauuccaggaaguaugaaaaugcagucugggaucaguauaaggacuuaugccacaugcacacaggugucguuguugaaaagaagaaaaagggcggcaaagaggaaauaaccccucacugugcacuaauggacugcaucauguuugaugcagcagugucaggaggacugaacacaucgguuuugagagcagugcugccuagagauaugguguucagaacaucgacaccuagagucguccuguaa

SEQ ID NO: 634 - RNA, 1710 nt, Artificial Sequence
  derived and/or modified CDS sequence (wt) from Lassa virus__AIT17311__NP
augagugccucaaaggaaauaaaauccuuuuuguggacacaauccuugaggagggaauuaucuggcuacugcuccaacaucaaacugcagguggucaaagaugcccaggcucuuuuacauggacuugacuucucugaaguuaguaauguucaacgguugaugcgcaaggagagaagggaugacaaugauuugaaacgguuaagggacuugaaucaagcggucaacaaucuugucgaauuaaaaucaacucaacaaaagaguguacugagaguugggacucuaaccucagaugacuuauuaaucuuggccgcugaucuagagaaguugaagucgaaggugaucagaacagaaaggccguugagugcaggugucuauauggguaaccugagcucacagcaacuugaccaaagaagggcucuucugaauaugauaggaaugggugguaguaaucaaggggcucgggcugggagagauggaguggucagaguuugggaugugaaaaaugcagaguugcucaauaaucaguucgggaccaugccaaguuugacacuggcaugucugacaaaacaggggcagguugacuugaaugaugcaguacaagcauugacagauuuagguuugaucuacacagcgaaguaucccaauacuucagacuuagacaggcugacucaaagucaccccauccuaaauaugauugacaccaagaaaagcucuuugaacaucucagguuauaauuuuagcuugggugcagcugugaaggcaggagccuguaugcuggaugguggcaauauguuggaaacaaucaaggugucaccucagacaauggaugguauucucaaguccauuuuaaaggucaagaaggcucuugggauguucauuucagauaccccuggugaaaggaauccuuaugaaaacauacucuacaagauuuguuugucaggagauggcuggccauacauugcaucaagaaccucaauaacaggaagggccugggaaaacacuguuguugaucuggaaucagaugggaagccacagaaagcuggcagcaaugguuccaauaaaucucugcagucggcaggauuuaccgcugggcuuaccuauucucagcugaugacccucaaggaugcaaugcugcaacuugacccaaaugcuaagaccuggauggacauugaaggaagaccugaagacccaguggaagucgcccucuaucaaccaaguucaggaugcuauauacacuucuuccgugagccuacugauuuaaagcaguucaaacaagaugcuaaguacucacaugggauugaugucacggaccucuuugcugcacaaccggguuugaccagugcugucauugaugcacucccccggaacauggucaucaccugccaggggucugaugacauaaggaaacuccuugaaucacagggaaggaaagacaucaaacugauugacauugcccucagcaagacugauuccaggaaguaugaaaaugcagucugggaccaguauaaagacuuaugccacaugcacacagguauuguuguugagaagaagaaaagaggcgguaaagaggaaauaacuccucacugugcauuaauggacugcaucauguuugaugcagcagugucaggaggacugaacacaucgguuuugagagcagugcugccuagagauaugguguucagaacaucgacaccuagagucguccuguaa

SEQ ID NO: 635 - RNA, 1710 nt, Artificial Sequence
  derived and/or modified CDS sequence (wt) from Lassa virus__AIT17315__NP
augagugccucaaaggagauaaaauccuuuuuguggacacaauccuugaggagggaauugucuggauacugcuccaacaucaaacugcagguggugaaagaugcccaggcucuuuuacacggacuugacuucucugaagucaguaauguucaacgauugaugcgcaaggagagaagggaugacaaugauuugaaacgguugagggaccuaaaucaagcgguuaacaaucuuguugaauuaaaaucaacucaacaaaagaguguacugagaguugggacucuaaccucagaugacuuauuaaucuuggcugcugaucuagagaaguugaagucgaaggugaccagaacagaaaggccauugagugcaggugucuauaugggcaaccugagcucacagcaacuugaccaaagaagagcucuuuugaauaugauaggaaugagugguagcaaucaaggggcucgggcuggaagagauggaguggucagaguuugggaugugaaaaauguagagcugcucaauaaucaguucgggaccaugccaagucugacacuggcaugucugacaaaacaggggcagguugacuugaaugaugcaguacaagcauugacagauuuagguuugaucuacacagcgaaguaucccaauacuucggacuuagacaggcugacucaaagucaccccauccuaaauaugauugacaccaagaaaagcuccuugaauaucucagguuauaauuuuagcuugggugcagcugugaaggcaggagcuuguaugcuagaugguggcaauaugcuggaaacaaucaaggugucaccucagacaauggaugguauucucaaauccauuuugaaggucaagaaagcucuugggauguucauuucagauaccccuggugaaaggaacccuuaugaaaacauacucuacaagauuugcuugucaggagauggcuggccauacauugcaucaagaaccucaauaacaggaagggccugggaaaacacuguuguugaucuggaaucagaugggaagccacagaaagcuggcagcaacaguuccaacaaaucucuacagucggcaggauucaccgcugggcuuaccuauucucagcugaugacccucaaggaugcaaugcugcaacuugacccaaaugcuaagaccuggauggacaucgaaggaagaccugaagauccaguagaaaucgcccucuaucaaccaaguucggggugcuacauacacuucuuccgugaacccacugaucuaaagcaguucaagcaggaugcuaaguacucacaugggauugaugucacggaucucuucgcugcacaaccgggcuugaccagugcugucauugaugcacucccccggaauauggucaucaccugccaggggucugaugacauaaggaaacuccuugaaucacaaggaagaaaagacaucaaacuaauugacauugcccucagcaagacugauuccaggaaguaugaaaaugcagucugggaucaguauaaagacuuaugccacaugcacacagguauuguuguugagaagaagaaaaaaggcaguaaagaggaaauaaccccucacugugcacuaauggauugcauuauguuugaugcagcagugucaggaggacugaacgcaucgguuuugagagcagugcugcccagagauaugguguucagaacaucgacaccuagagucguccuguaa

SEQ ID NO: 636 - RNA, 1710 nt, Artificial Sequence
  derived and/or modified CDS sequence (wt) from Lassa virus__AIT17319__NP
augagugccucaaaggagauaaaguccuucuuguggacacaaucuuugaggagggaauugucugguuacugcucuaacaucaaacuacagguggugaaagaugcccaggcucuuuuacauggacuugacuucucugaagucagcaauguucagcgguugaugcgcaaacagaggagagaugacagugaucuaaaacgauugagggauuuaaaucaagccguuaacaaucuugucgagcugaaaucaacucaacagaagaguguacugagaguugggacucuaaccucagaugacuuguuaguuuuggcugcugaucuagagaagcugaaaucgaaggugauuagaacagaaaggccacuaagcucagguguuuauaugggcaaccugaguucacaacaacuugaccaaagacgagcucuccugaauaugauaggaaugagugguggcaaucagggggcucaagucgggagagauggaguggugagagucugggauguaaagaaugcagauaugcucaacaaucaguuuggcaccaugccaagucuaacacuggcauguuuaacaaaacaagggcagguugaccugaaugauguagugcaagcacuaacagauuuaggccugaucuacacagcaaaguauccuaacacuucagacuuggacagauuggcucagagccacccuauucuaaacaugauagacaccaaaaaaagcucccugaacaucucagguuacaauuuuagcuugggugcagcugugaaagcaggagccugcaugcuggauggugguaacauguuagagacaaucaaggugucaccucaaacaauggauggcauccugaaguccaucuuaaaagugaaaaaggcucuugggauguucauaucugaaaccccuggugaaaggaauccuuaugagaacauacucuacaagauuuguuugucaggggauggguggccauauauugcaucaagaaccucaauaacagggagggcuugggaaaacacuaucguugaucuagaaucggaugggaagccacagaaagcugggagcaauaauuccaauaagucccugcagucggcaggauucaccgccgggcuuaccuauucccagcucaugacccucaaggacucaaugcugcagcuugauccaaaugccaagaccuggauggacauugagggaagaccugaggauccgguggagguugcccuuuaucaaccaaguucaggcugcuauauucacuucuuucgugagccuacugauuugaagcaguuuaagcaagaugccaaguauucacauggaauugaugucacagaccucuucgcugcacagccagguuugaccagugcuguuauagaggcacuuccucggaacauggucaucaccugucagggaucugaugacauucgaaagcuccuugaaucacaggggagaaaggauaucaaacugauugacauuguucucaacaaaacugauucuaggaaguaugagaaugcagucugggaucaguacaaagacuuaugccauaugcacacaggugucguuguugagaagaagaaaagaggugguaaagaggagauaaccccucacugugcccugauggacugcaucauguuugacgcagcagugucagguggauugaaaacaaugguucugagagcagugcuacccagagacaugguguucagaacaucgacacccaaagucguccuguaa

SEQ ID NO: 637 - RNA, 1710 nt, Artificial Sequence
  derived and/or modified CDS sequence (wt) from Lassa virus__AIT17323__NP
augagugccucaaaggagauaaaguccuuccuguggacacaaucuuugaggagggaauugucugguuacugcucuaacaucaaacuacagguggugaaagaugcccaggcucuuuuacauggacuugacuucucugaggucagcaauguucagcgguugaugcguaaacagaggagagaugacagugaucuaaaacgauugagggauuuaaaucaagccguuaauaaucuugucgagcugaaaucaacucaacagaagaguguacugagaguuggaacucugaccucagaugacuuguuaguuuuggcugccgaccuagagaagcugaaaucaaaagugauuagaacagaaagaccacuaagcucagguguuuauaugggcaaccugaguucgcaacaacuugaccagagacgagcucuccugaauaugauaggaaugagugguggcaaucagggggcucaagucgggagagauggaguggugagaguuugggaugugaagaaugcagauuugcucaacaaucaguuuggcaccaugccaagucugacacuggcauguuuaacaaaacaagggcagguugacuugaaugauguagugcaagcacuaacagauuuaggccugaucuacacagcaaaguauccuaacacuucagacuuggacagguuggcucagagccacccuauucuaaacaugauagacaccaaaaagagcucccugaacaucucagguuacaauuuuagcuugggcgcagcugugaaggcaggagccugcaugcuggauggugguaacauguuagagacaaucaaggugucaccucaaacaauggauggcauccugaaguccaucuugaaagugaaaaaggcucuugggauguucauaucugaaaccccuggcgaaaggaauccuuaugagaacauacucuacaagauuuguuugucaggggauggguggccauauauugcaucaagaaccucaauaacagggagggcuugggaaaacaccaucguugaucuggaaucggaugggaaaccacagaaagcugggagcaauaauuccaauaagucucugcagucggcaggauucaccgccgggcuuaccuauucucagcucaugacccucaaagauucaaugcugcagcuugauccaaaugcuaagaccuggauggacauugagggaagaccugaggauccgguggaaguugcccuuuaucaaccaaguucaggcugcuacauucacuucuuucgugagccuacugacuugaagcaguucaagcaagaugcuaaguauucacauggaauugaugucacagaccucuucgcugcacagccagguuugaccagugcuguuauagaggcgcuuccucggaacauggucaucaccugucaaggaucugaugacauucgaaagcuccuugaaucacaagggagaaaggauaucaaacuaauugacauugcucucaacaaaacugauucuaggaaguaugagaaugcagucugggaucaguacaaagacuuaugccacaugcacacaggugucguuguugagaagaagaaaagaggugguaaagaggagauaaccccucacugugcccugauggauugcaucauguuugaugcagcagugucagguggauugaagacacugguucugagagcagugcuacccagagacaugguguucagaacaucuacacccaaagucguccuguaa

SEQ ID NO: 638 - RNA, 1710 nt, Artificial Sequence
  derived and/or modified CDS sequence (wt) from Lassa virus__AIT17325__NP
augagugccucaaaggagauaaaguccuuccuauggacacaauccuugaggagagaauuaucuggcuauuguuccaacaucaaacuacagguggugaaggaugcccaggcucuuuuacauggacuugacuucucugaaguaagcaauguccagcgguugaugcgcaaacaaaggagggaugauaaugaucuaaaacgguugagggauuuaaaccaagcagugaacaaccuuguugagcugaaaucuacucagcaaaagaguguacugaggguugggacucugaccucagaugacuugcuaguucuagcugcugaccuugagaaacuaaaaucaaaagugaccagaacagaaaggccuuugagcgcagguguuuacaugggcaaccugagcucacagcaacuugaccaaagacgagcucuucuaaauaugauaggaaugacugguggcagucgaggggcucaggcugggggagauggaguggugagaguuugggaugugaagaacgcagaccugcuuaacaaucaguucggcaccaugccaagucugacauuggcauguuuaacaaaacaaggacaaguugacuugaaugauguaguacaggcacuaacagauuugggucugaucuacacagcaaaguaccccaacaccucagacuuagacaggcugacucagagccaccccauccuaaacaugauagacaccaagaaaaguucccugaacaucucaggcuacaauuuuagcuugggugcagcugugaaagcaggagccuguaugcuagaugguggcaacaugcuggagacaaucaagguaucaccucagacaauggauggcauccucaagucuauacugaaggucaaaaagagucuuggaauguucauuucagacacccccggugaaaggaacccuuaugaaaauauacucuacaaaauuuguuugucaggggauggauggccauauauugcaucaagaacuucaauaacaggaagagccugggaaaacacugucguugaccuggaaucagauggaaaaccacagaaagcugggggcaacaauuccaacaaaucccuccagucagcaggguucacugcugggcucacuuauucucaacucaugacucucaaggauacaaugcugcagcuugauccaaaugccaagacuuggauggauauugagggaagaccugaagauccgguggaggucgcucucuaucagccaaguucagguuguuacauucacuucuuccgugaaccuacugauuuaaaacaauucaaacaagaugcuaaguauucacauggaauugauguuacagaccucuucgcugcacagccaggcuugaccagugcuguuauagaagcacuuccccggaacauggucaucaccugucagggaucugaugacauaagaaagcuucuugaaucacaaggaagaaaagauauuaaacuaauugacauugcccucagcaaaguugacucuagaaaguaugaaaaugcaguuugggaccaauauaaagauuuaugccauaugcauacaggaguuguuguugaaaagaagaaaagagguggcaaagaggaaauaaccccacacugugcucuaauggauugcauuauguuugaugcagcagugucaggaggauugaacacauugguucugagggcagugcuaccuagagacaugguguuuagaacaucuacacccaaggucguccuguaa

SEQ ID NO: 639 - RNA, 1710 nt, Artificial Sequence
  derived and/or modified CDS sequence (wt) from Lassa virus__AIT17329__NP
augagugccucaaaggaaaucaaauccuuuuuguggacacaaucuuugaggagagaacuaucugguuacugcuccaacaucaaacuacagguggugaaagaugcccaggcucuuuuacauggacuugacuucucugaggucagcaauguucaacgguugaugcgcaaggagagaagggaugacagugauuugaaacgauugagagaccuaaaucaaacagucaacaaucuuguugaauuaaaaucaacucaacagaagaguauacugagaguugggacucuaaccucagaugacuuauuaaucuuagccgcugauuuagagaaguugaagucaaaggugaucagaacagaaaggccauugagugcaggugucuauaugggcaaucugagcucacagcaacuugaccaaagaagagcucuucugaauaugauaggaaugaguagugguaaucaaggggcucaggcugggagagauggagugguaagaguuugggaugugaaaaaugcagaguugcucaauaaucaguucgggaccaugccaagucugacacuggcaugucugacaaaacaggggcagguugacuugaaugaugcaguacaagcauuaacagauuuggguuugaucuacacagcaaaguaucccaacacuucagacuuagacaggcugacucaaagccaccccauccuaaauaugauugacaccaagaaaagcuccuuaaauaucucagguuacaauuuuagcuugggugcagcuguaaaggcaggagcuugcaugcuggaugguggcaauauguuggaaacaaucaaggugucaccucagacaauggaugguauccucaaauccaucuuaaaggucaagaaggcucuuggaauguucauuucagacaccccuggcgagaggaauccuuaugaaaacauacucuacaagauuuguuugucaggggauggauggccauauauugcaucaagaacuucaauaacaggaagggccugggaaaacacugucguugauuuggaaucagaugggaugccacagaaggcugguagcagcaguuccaauaaaucccugcagucggcaggguuugucgcugggcuuaccuauucucagcugaugacccucaaagaugcaaugcugcaacuugacccaaaugcuaagaccuggauggauauugagggaagaccugaagauccaguggaaauugcccucuaucaaccaaguucaggcugcuacauacacuucuuccgugaaccuacugauuuaaagcaguucaaacaagaugcuaaguacucacaugguauugauguuacagaccucuucgcugcacaaccgggcuugaccagugcuguuauugaugcacucccccggaauauggucauuaccugucagggguccgaugacauaaggaaacuucuugaaucacaaggaagaaaggauaucaaacuaauugauauugcccucagcaaagcugauuccaggaaguaugaaaaugcagucugggaucaguauaaagaccuaugccacaugcacacagguguuguuguugaaaagaagaaaagaggcggcaaggaggaaauaaccccucacugugcacuaauggacugcaucauguaugaugcagcagugucaggaggacugaacacaucaguuuugagagcagugcugcccagagauaugguguucagaacaucgacacccagagucguccuguaa

SEQ ID NO: 640 - RNA, 1710 nt, Artificial Sequence
  derived and/or modified CDS sequence (wt) from Lassa virus__AIT17333__NP
augagugccucaaaggagauaaaauccuuuuuguggacacagucuuugaggagggaguuaucugguuacugcuccaacaucaaacuacagguggugaaagaugcucaagcccuuuuacauggacuugacuuuuccgaagucaguaauguucaacgguugaugcgcaaggagaggagggaugacaaugauuugaaacgguugagagaccugaaucaagcgguaaacaaucuuguugaauuaaaaucaacucaacaaaagaguguacugaggguugggacucuaaccucagaugacuuguuaauccuggccgcugaucuagagaaguugaagucaaaggugaccagaacagaaaggccacugagugccggugucuauaugggcaaccuaagcucacagcaacuugaccaaagaagagcucuucugaauaugauaggaaugagugguggcaaucaaggggcucgggcugggagagauggagugguaagaguuugggaugugaaaaaugcagaguugcucaauaaucaguucggaaccaugccaagccugacacuggcaugucugacuaaacaggggcagguugacuugaaugaugcaguacaggcacugacagauuuggguuugaucuacacagcaaaguaucccaauacuucagacuuagacaggcugacucaaagucaccccauucuaaauaugauugacaccaagaaaagcucuuugaauaucucagguuauaacuuuagcuugggugcagcugugaaggcaggagccugcaugcuggaugguggcaacauguuggagacaaucaaggugucaccucagacaauggauagcauccuuaaauccauuuuaaaagucaaaaaggcucuagggauguuuauuucagacaccccuggugaaaggaauccuuaugaaaacauacucuacaagauuuguuugucaggagauggauggccauauauugcaucaagaaccucaauaacaggaagggcuugggaaaacacugucguugaucuggaaucagaugggaagccacagaaagcuggcagcaacaauuccaacaaaucccuacagucggcaggguuugcagcugggcucaccuauucucagcugaugacccucaaagaugcaaugcugcaacuugacccaaaugcuaagacuuggauggacauugaaggaagacccgaagacccaguggaaauagcccucuaucaaccaaguucagguugcuacauacacuucuuucgugaaccuacugauuuaaagcaguucaagcaggaugcuaaguacucacaugggauugaugucacagaccucuuugcugcacaaccuggcuugaccagugcuguuauugaugcacucccccggaauauggucaucaccugucagggguccgaugacauaaggaaacuccuugaaucacaaggaaggaaagacaucaaauuaauugauauugcccucagcaagacugauuccaggaaguaugaaaaugcagucugggaucaauauaaagaccuaugucacaugcacacagguauuguuguugagaagaagaaaagaggcgguaaagaggaaauaacuccucacugugcacuaauggacugcaucauguuugaugcagcagugucaggagggcugaacacaucaguuuugagagcagugcugcccagagauaugguguucagaacaucgacaccuagagucguccuguaa

SEQ ID NO: 641 - RNA, 1710 nt, Artificial Sequence
  derived and/or modified CDS sequence (wt) from Lassa virus__AIT17335__NP
augagugccucaaaggaaauaaaguccuuucuguggacacagucauugaggagggaauugucugguuauugcucuaacaucaaacuacagguggugaaagaugcgcaagcucuuuuacauggacuugacuucuccgaagucaguaauguucaacgguugaugcgcaaggagagaagagaugacagugauuugaaacgguugagggaccuaaaucaagcugucaacaaccuuguugaguuaaaaucaacucaacaaaaaaguauacugagaguugggacccuaaccucagaugacuuauuaauuuuagcugcugaucuagagaaguugaaaucaaaggugaccaggacagaaaggccauugagugcaggugucuauaugggcaaccugagcucacagcaacuugaccaaagacgagcucuucugaguaugauaggaaugaguagugguguucaaggggcucgggcugggagagauggaguggugagaguuugggauguaaaaaaugcagaguugcuuaauaaucaguucggaaccaugccgagucugacacuagcauguuugacaaaacaggggcagguugacuugaaugacguagugcaagcacugacagauuugggucuaaucuacacagcaaaguauccaaauacuucagauuuagauaggcugacucaaagucaccccauccugaacaugauugacaccaagaaaagcucucugaauaucucagguuauaauuuuagcuugggugcagcugugaaggcaggagcuugcaugcuggacgguggcaacauguuggagacaauuaaggugucaccucagacaauggauggcauccucaaguccaucuuaaaggucaagaaagcucuugggauguucaucucagagaccccuggugaaaggaacccuuaugagaacauacucuacaagauuugcuuaucaggagauggauggccauauauugcaucaagaaccucaauaacaggaagggcuugggaaaacacugucguugauuuggaaucagaugggaagccacagaaagcuggcagcaacaacuccaauaaaucucugcaguccacaggguuugcugcugggcuuaccuauucucagcugaugacccucaaagacgcaaugcugcaacuugacccaaaugcuaagaccuggauggacauugaaggaagaccugaagauccaguggagguugcccucuaucaaccaaguucaggcugcuacauacacuucuuccgugaacccacugauuuaaagcaguucaagcaggaugcuaaguacucacaugggauugauguuacagaccucuucgcugcgcaaccgggcuugaccagugcugucauagaugcacuuccccgaaauauggucauuaccugucaggggucugaugacauaaagaaacuccuugaaucacaagguagaaaagacaucaagcuaauugacauugcccucaguaaaacugauuccaggaaguaugaaaaugcagucugggaucaauauaaagacuuaugccacaugcacacagguguugucguugaaaagaagaaaagaggcgguaaagaggaaauaaccccucacugugcacuaauggacugcaucauguuugaugcagcaguaucaggaggacugaacacaucggucuugagagcagugcugcccagagauaugguguucagaacaucgacaccuagagucguccuguaa

SEQ ID NO: 642 - RNA, 1710 nt, Artificial Sequence
  derived and/or modified CDS sequence (wt) from Lassa virus__AIT17341__NP
augagugccucaaaggaaauaaaauccuuuuuguggacacaaucuuugaggagggaauuaucugguuacugcuccaacaucaaacugcagguggugaaggaugcccaggcucuuuuacaugggcuugacuucucugaagucaguaauguucaacgguugaugcgcaaggagagaagggaugacaaugauuuaaaacgguugagggaccuaaaucaagcagucaacaaucuuguugaauuaaaaucaacucaacaaaagagcauacugagaguugggacucuaaccucagaugacuuauuaauccuggccgcugaucuagagaaguugaagucgaaggugaccagaacagaaaggccauugagugcaggugucuauaugggcaaccuaagcucacagcaacuugaccaaagaagagcucuucugaacaugauaggaaugaguggugguaaucaaggggcucgggcugggagagauggaguggucagaguuugggaugugaaaaaugcagaguugcucaauaaucaguucgggaccaugccaagucugacacuggcaugucugacaaaacaggggcagguugacuugaaugaugcaguacaagcauugacagauuuagguuugaucuacacagcgaaguaccccaauacuucagacuuggacaggcugacucaaagucaccccauccuaaauaugauugacaccaagaaaagcucuuugaacaucucagguuauaauuuuagcuugggugcagcugugaaggcaggagcuuguaugcuggaugguggcaauauguuggaaacaaucaaggugucaccucagacaauggaugguauucucaaauccauuuuaaaggucaagaaggcucuugggauguucauaucagaugccccuggugaaaggaauccuuaugaaaacauacucuacaagauuuguuugucaggagacggauggccauacauugcaucaagaaccucaauaacaggaagggccugggaaaacacuguuguugaucuagaaucagaugggaagccacagaaagcuggcaguaacgguuccaauaaaucucugcagucggcaggguuuaccgcugggcucaccuauucucagcugaugacccucaaggaugcaaugcugcaacuugacccaaaugcuaagaccuggauggacauugaaggaagaccugaagauccaguggaaaucgcccucuaucaaccaaguucagggugcuacauacacuucuuccgugaaccuacugauuuaaagcaguucaagcaggaugcuaaguacucacaugggauugaugucacggaccucuucgcugcacagccgggcuugaccagugcugucauugaugcacucccccggaauauggucaucaccugccagggaucugaugacauaaggaaacucuuugaaucacaaggaagaaaagacauuaaacuaauugacauugcccucagcaaggcugauuccaggaaguaugaaaaugcagucugggaucaguauaaagacuuaugccacaugcauacagguguuguuguugagaagaagaaaagaggugguaaagaggaaauaaccccucacugugcacuaauggacugcauuauguuugaugcagcaguaucaggaggacugaacacaucaguuuugagagcagugcugcccagagacaugguguucagaacaucgacaccuagggucguccuguaa

SEQ ID NO: 643 - RNA, 1710 nt, Artificial Sequence
  derived and/or modified CDS sequence (wt) from Lassa virus__AIT17345__NP
augagugccucaaaggaaauaaaguccuuucuguggacacagucauugaggagggaauugucugguuauuguucuaacaucaaacuacagguggugaaagaugcgcaagcucuuuuacauggacuugacuucuccgaagucaguaauguucaacgguugaugcgcaaggagagaagggaugacaaugauuugaaacgguugagggaccuaaaucaagcugucaacaaccuuguugaguuaaaaucaacucaacaaaaaaguauacugagaguugggacccuaaccucagaugacuuguuaaucuuggcugcugaucuagagaaguugaaaucaaaggugaccaggacagaaaggccauugagugcaggugucuauaugggcaaccugagcucacagcaacuugaccaaagacgagcucuucugaguaugauaggaaugaguagugguguucaaggggcucgggcugggagagauggaguggugagaguuugggauguaaaaaaugcagaguugcuuaauaaucaguucggaaccaugccaagucugacacuagcauguuugacaaaacaggggcagguugacuugaaugauguagugcaagcauugacagauuuggguuugaucuacacagcaaaguacccaaauacuucagauuuagauaggcugacucaaagucaccccauccugaacaugauugacaccaagaaaagcucuuugaauaucucagguuauaauuucagcuugggugcagcuguaaaggcaggagcuugcaugcuggaugguggcaacauguuggagacaaucaaggugucaccucagacaauggauggcauccucaaguccaucuuaaaggucaagaaagcucuugggauguucaucucagagaccccuggugaaaggaauccuuaugagaacauacucuacaagaucugucuaucaggagauggauggccauauauugcaucaagaaccucaauaacaggaagggccugggaaaacacugucguugaucuggaaucagaugggaagccacaaaaagcuggcagcaacaauuccaauaaaucccugcagucggcaggguuuaccgcugggcuuaccuauucucagcugaugacccucaaagacgcaaugcugcaacuugacccaaaugcuaagaccuggauggacauugaaggaaggccugaagauccaguggagguugcccucuaucaaccaaguucaggcugcuacauacacuucuuccgugaacccacugauuugaagcaguucaagcaggaugcuaaguacucacaugggauugauguuacagaccucuucgcugcgcaaccaggcuugaccagugcugucauagaugcacuuccccggaauauggucauuaccugucaggggucugaugacauaaagaaacuccuugaaucacaagguaggaaagacaucaagcuaauugauauugcccucaguaaaacugauuccaggaaguaugaaaaugcagucugggaccaguauaaagacuuaugccacaugcacacagguguugucguugaaaagaagaaaagaggcgguaaagaggaaauaaccccucacugugcacuaauggacugcaucauguuugaugcagcaguaucaggaggacugaacacaucggucuuaagagcagugcugcccagagauaugguguucagaacaucgacaccuagagucguucuguaa

SEQ ID NO: 644 - RNA, 1710 nt, Artificial Sequence
  derived and/or modified CDS sequence (wt) from Lassa virus__AIT17351__NP
augagugccucaaaggagauaaaguccuucuuguggacacaaucuuugaggagggaacuuucugguuauuguuccaauauuaaauuacagguggugaaagacgcccaagcucucuuacauggacuugauuucucugaagucagcaauguucagcgauugaugcgcaaacagagaagggaugauggugaucuaaaacgguugagggaucucaaucaagcaguuaacaaccuuguugaguugaaaucaacucaacaaaagaguguguugagaguugggacuuugaccucagaugaccugcuaaucuuggcugcugaccuagagaaacugaaaucaaaaguaauuaggacagaaaggccguugagugcagguguuuauauggguaaccugaguucacaacaacuugaacagagacgggcucucuuaaacaugauaggaaugagcaguggcaaucaaggggcucggaccgggaaagauggaguggugagaauuugggaugugaagaaugcggacuugcuuaacaaucaguuugguaccaugccaagucuaacacuggcauguuugacaaaacaggggcagguugaccuaaaugauguugugcaggcgcuaacagauuugggucugauuuacacagcaaaauacccuaacacuucagacuuagacaggcugacucagagccaccccauucuaaauaugguagacaccagcaaaagcuccuugaacaucucagguuauaauuuuagucugggugcagcuguaaaagcaggagcuugcaugcuagauggugguaacauguuggagacaaucaaggugucaccucagacaauggauggcauccucaaguccauuuuaaagguuaaaaagagucuugggauguucguaucagacaccccuggcgaaaggaauccuuaugaaaauauacucuacaaaauuugucugucaggggauggguggccguacauugcaucaagaacuucaauaacaggaagggccugggaaaacacugucguugauuuggaaucaaaugggaagccacaaaaagcugggagcaacaauuccaacaaaucucuacagucaacaggauucacugcagggcucaccuauucucagcucaugacucucaaagaugcaaugcugcagcuugauccaaaugcuaagacuuggauggacauugaagggagaccugaagauccgguggaaauugcuuuguaucagccaaguucaggcugcuacauucacuucuuccgugagccuacugacuuaaagcaguuuaagcaagaugcuaaguacucacaugguauugaugugacagaccucuucgcugcacaaccuggcuugaccagugcuguuauagacacacucccucggaauaugguuaucaccugccaggggucugaugacauaaggaaacuccuugaaucacagggaagaaaagacaucaaacuaauugacauugcccucaguaaaauugauucuaggaaguaugaaaaugcagucugggaucaguauaaagacuuaugccauaugcacacagguguugucguugagaagaagaaaagagguggcaaagaggaaauaaccccucacugugcucuaauggacugcaucauguuugaugcagcaguuucaggaggacugaaugcaucaguucugagagcuguguuaccuagagauaugguguuuagaacaucgacaccuagagucguccuguaa

SEQ ID NO: 645 - RNA, 1710 nt, Artificial Sequence
  derived and/or modified CDS sequence (wt) from Lassa virus__AIT17359__NP
augagugccucaaaggaaauaaaauccuuuuuguggacacaauccuugaggagggaauugucugguuacugcuccaacaucaaacugcagguggugaaagaugcccaggcucuuuuacacggacucgacuucucugaagucaguaauguucaacgguugaugcgcaaggagagaagggaugacagugauuugaaacgguugagggacuuaaaucaagcggucaacaaucuuguugaauuaaaaucaacucaacaaaagaguauacugagagucgggacucuaaccucagaugacuuauuaauccuggcugcugaucuagagaaguugaagucgaaggugaccaggacagaaaggccauugagugcaggugucuauaugggcaaccugagcucacagcaacuugaccagagaagagcucuuuugaacauguuaggaaugagugguagcaaucaaggggcucgggcuggaagagauggaguggucagaguuugggaugugaaaaaugcagaguugcucaauaaucaguucgggacuaugccaagucugacacuggcaugccugacaaaacaggggcagguugaccugaaugaugcaguacaagcauugacagauuuagguuugaucuacacagcgaaguaucccaauacuucggacuuagacaggcugacucaaagucaccccauccuaaauaugauugacaccaagaaaagcuccuugaauaucucagguuauaauuuuagcuugggugcagcugugaaggcaggagcuuguaugcuggaugguggcaauauguuggagacaaucaaggugucaccucagacaauggaugguauucucaaauccauuuugaaggucaaaaaagcucuugggauguucauuucagauaccccuggugaaaggaacccuuacgagaacauacucuacaagauuugcuugucaggagauggcuggccauacauugcgucaagaaccucaauaacaggaagggccugggaaaacacuguuguugaucuggaaucagacgagaagccacagaaagcuggcagcaacaguuccaacaaaucucugcagucggcaggauuuaccgcugggcuuaccuauucucagcugaugacccucaaggaugcaaugcugcaacuugacccaaaugcuaagaccuggauggacaucgaaggaagaccugaagauccaguggaaaucgcccucuaucaaccaaguucggggugcuacauacacuucuuccgugaaccuacugaucuaaagcaguucaagcaggaugcuaaguacucacaugggauugaugucacggaucuuuucgcugcacaaccgggcuugaccagugcugucauugaugcacucccccggaauauggucaucaccugccaggggucugaugacauaaggaaacuccuugaaucacaaggaagaaaagacaucaaacuaauugacauugcccucagcaagacugauuccaggaaguaugaaaaugcagucugggaucaguauaaagacuuaugccacaugcacacaggcauuguuguugagaaaaagaaaagaggcgguaaagaggaaauaaccccucacugugcacuaauggauugcauuauguuugaugcagcagugucaggaggacugaacgcaucgguuuugagagcagugcugcccagagauaugguguucagaacaucgacaccuagagucguccuguaa

SEQ ID NO: 646 - RNA, 1710 nt, Artificial Sequence
  derived and/or modified CDS sequence (wt) from Lassa virus__AIT17361__NP
augagugccucaaaagaaauaaaguccuuuuuguggacacaaucuuugaggagggaauuaucuggcuacugcuccaacaucaaacuucagguggugaaagaugcucaggcucuuuugcauggacuugacuucuccgaagucagcaauguucaacgguugaugcgcaaagagagaagggaugacagugauuugaaacgguugagggaccugaaccaagcggucaacaaccuuguugaguuaaaaucaacucaacaaaagaguguacugagaguugggacucuaaccucagaugacuuauuagucuuagcugcugaucuagagaagcugaaaucaaaggugaccaggacagaaaggccauugagcgcaggugucuauaugggcaaccugagcucacagcaacuugaccaaagacgagcucuucugaacaugauaggaaugaguggugguaaucaaggagcucgggcugggagagauggaguggugagaauuugggaugucaaaaaugcagaguugcuuaauaaucaguucgggaccaugccaagucugacacuggcauguuugacaaaacaagggcagguugacuuaaaugaugucgugcaagcauugacagauuuggguuugaucuacacagcaaaguaccccaacacuucagacuuggacaggcugacucaaagucacccuauccuaaauaugauugacaccaagaaaagcucuuugaauaucucagguuacaauuuuaguuugggugcagcugugaaggcaggagcuugcaugcuagaugguggcaauauguuggagacaaucaaggugucaccucagacaauggaugguauccucaaauccauuuuaaaggucaagaaggcucucgggauguucauuucagacacuccuggugagaggaauccuuaugaaaacauacucuauaagauuuguuugucaggggauggauggccauauauugcaucaagaacuucaauaacaggaagggccugggaaaacacuaucguugaucuggagucggaugggaagccacagaagacuaauaacaccaauuccaacaaaucccugcagucggcaggguuugccgcugggcuaacauauucucagcuuaugacccucaaggaugcaaugcugcaacuugacccaaaugccaagaccuggauggacauugaagggagacccgaagauccaguagaaauugcccucuaucaaccaaguucaggcugcuacauacacuucuuccgugagccuacugauuuaaagcaguucaagcaggaugcuaaauacucacaugggauugaugucacagaccucuuugcugcacaaccaggccugaccagugcuguuauagauacacucccccggaacaugguuauuaccugucagggguccgaagacauuaggagacuccuugaaucacaaggaagaaaagacaucaaacuaauugauauugcccucagcaagacugauuccaggaaguaugagaaugcagucugggaucaguauaaagauuuaugccacaugcacacaggugucguuguugaaaagaagaagaagggcgguaaagaggaaauaacuccccacugugcacuaauggauuguaucauguuugaugcagcagugucaggaggacugaacacaucaguuuugagagcagugcuacccagagacaugguguucagaacaucaacaccuagagucguccuguaa

SEQ ID NO: 647 - RNA, 1710 nt, Artificial Sequence
  derived and/or modified CDS sequence (wt) from Lassa virus__AIT17365__NP
augagugccucaaaggaaauaaaauccuuuuuguggacacaauccuugaggagggaauuaucugguuacugcuccaacaucaaacugcagguggugaaggaugcccaggcucuuuuacaugggcuugacuucucugaagucaguaauguucaacgguugaugcgcaaggagagaagggaugacaaugauuugaagcgguugagggaccuaaaucaagcagucaacaaucuuguugaauuaaaaucaacucaacaaaagaguauacugagaguugggacucuaaccucagaugacuuauuaaucuuggccgcugaucuagagaaguugaagucgaaggugaccagaacagaaaggccauugagugcaggugucuauaugggcaaccuaagcucacagcaacuugaccaaagaagagcccuucugaacaugauaggaaugagugguaguaaucaaggggcucaggcugggagagauggaguggucaggguuugggaugugaaaaaugcagaguugcucaauaaucaguucgggaccaugccaaguuugacacuggcaugucuaacaaaacaggggcagguugacuugaaugaugcaguacaagcauugacagauuuagguuugaucuacacagcgaaguaccccaauacuucagacuuggacaggcugacucaaagucaccccauccuaaauaugauugauacuaagaaaagcucuuugaacaucucagguuauaauuuuagcuugggugcagcugugaaggcaggagcuuguaugcuggaugguggcaauauguuggagacaaucaaggugucaccucagacaauggaugguauucucaaauccauuuuaaaggucaaaaaggcucuugggauguucauuucagaugccccuggugaaaggaauccuuaugaaaacauacucuacaagauuuguuugucaggagacggauggccauacauugcaucaagaaccucaauaacaggaagggccugggaaaacacuguuguugaucuggaaucagaugggaagccacagaaagcuggcaguaacgguuccaauaaaucucugcagucggcaggauuuaccgcugggcucaccuauucucagcugaugacccucaaggaugcaaugcugcaacuugacccaaaugcuaagaccuggauggacauugaaggaagaccugaagauccaguggaaaucgcccucuaucaaccaaguucagggugcuacauacacuucuuccgugaaccuacugauuuaaagcaguucaagcaggaugcuaaguacucacaugggauugaugucacggaccucuucgccgcacaaccgggcuugaccagugcugucauugaugcacucccccggaauauggucaucaccugccaggggucugaugacauaaggaaacucuuugaaucacaaggaagaaaagacauuaaacuaauugacauugcccucagcaagacugauuccaggaaguaugaaaaugcagucugggaucaguauaaagacuuaugccacaugcauacagguauuguuguugagaagaagaaaagaggcggcaaagaggaaauaaccccucacugugcacugauggacugcaucauguuugaugcagcaguaucaggaggacugaacacaucaguuuugagagcagugcugcccagagacaugguguucagaacaucgacaccuagggucguccuguaa

SEQ ID NO: 648 - RNA, 1710 nt, Artificial Sequence
  derived and/or modified CDS sequence (wt) from Lassa virus__AIT17371__NP
augagugccucaaaggaaauaaaauccuuuuuguggacacaauccuugaggagggaauuaucugguuacugcuccaacaucaaacugcagguggugaaggaugcccaggcucuuuuacaugggcuugacuucucugaagucaguaauguucaacgguugaugcgcaaggagagaagggaugacaaugauuugaagcgguugagggaccuaaaucaagcagucaacaaucuuguugaauuaaaaucaacucaacaaaagaguauacugagaguugggacucuaaccucagaugacuuauuaaucuuggccgcugaucuagagaaguugaagucgaaggugaccagaacagaaaggccauugagugcaggugucuauaugggcaaccuaagcucacagcaacuugaccaaagaagagcccuucugaacaugauaggaaugagugguaguaaucaaggggcucaggcugggagagauggaguggucaggguuugggaugugaaaaaugcagaguugcucaauaaucaguucgggaccaugccaaguuugacacuggcaugucuaacaaaacaggggcagguugacuugaaugaugcaguacaagcauugacagauuuagguuugaucuacacagcgaaguaccccaauacuucagacuuggacaggcugacucaaagucaccccauccuaaauaugauugauacuaagaaaagcucuuugaacaucucagguuauaauuuuagcuugggugcagcugugaaggcaggagcuuguaugcuggaugguggcaauauguuggagacaaucaaggugucaccucagacaauggaugguauucucaaauccauuuuaaaggucaagaaggcucuugggauguucauuucagaugccccuggugaaaggaauccuuaugaaaacauacucuacaagauuuguuugucaggagacggauggccauacauugcaucaagaaccucaauaacaggaagggccugggaaaacacuguuguugaucuggaaucagaugggaagccacagaaagcuggcaguaacaguuccaauaaaucucugcagucggcaggauuuaccgcugggcucaccuauucucagcugaugacccucaaggaugcaaugcugcaacuugacccaaaugcuaagaccuggauggacauugaaggaagaccugaagauccaguggaaaucgcccucuaucaaccaaguucagggugcuacauacacuucuuccgugaaccuacugauuuaaagcaguucaagcaggaugcuaaguacucacaugggauugaugucacggaccucuucgccgcacaaccgggcuugaccagugcugucauugaugcacucccccggaauauggucaucaccugccaggggucugaugacauaaggaaacucuuugaaucacaaggaagaaaagacauuaaacuaauugacauugcccucagcaagacugauuccaggaaguaugaaaaugcagucugggaucaguauaaagacuuaugccacaugcauacagguauuguuguugagaagaagaaaagaggcggcaaagaggaaauaaccccucacugugcacugauggacugcaucauguuugaugcagcaguaucaggaggacugaacacaucaguuuugagagcagugcugcccagagacaugguguucagaacaucgacaccuagggucguccuguaa

SEQ ID NO: 649 - RNA, 1710 nt, Artificial Sequence
  derived and/or modified CDS sequence (wt) from Lassa virus__AIT17379__NP
augagugccucaaaggaaauaaaauccuuuuuguggacacaaucuuugaggagggaguuaucugguuacugcuccaacaucaaacuacagguggugaaagaugcccaagcccuccuacauggacuugacuuuuccgaagucaguaauguucaacgguugaugcgcaaggagaggagggaugauagugauuugaaacgguugagagaccugaaucaagcggucaacaaucuuguugaauuaaaaucaacucaacaaaaaaguguacugaggguggggacucuaaccucagaugacuugcuaaucuuggccgcugaucuagagaaguuaaagucaaaggugaccaggacagaaaggccauuaagugcagguguuuauaugggcaaccuaagcucacagcaacuugaccaaagaagagcucuucugaauaugauaggaaugaguaguggcaaccgaggggcucaggcugggagagacggagugguaagaguuugggaugugaaaaaugcagaguugcucaauaaucaguucgggaccaugccaagcuugacacuggcaugucugacaaaacaggggcagguugacuugaaugaugcaguacaagcauugacagauuuggguuugaucuacacagcaaaguaucccaacacuucagacuuagacaggcugacucaaagccaccccauccuaaacaugguugacacuaagaaaagcucuuugaauaucucagguuauaauuuuagcuugggugcggcugugaaggcaggagccugcaugcuggaugguggcaacauguuggagacaaucaaggugucaccucagacaauggaugguauccucaaguccauuuuaaaggucaaaaaggcucuagggauguucauuucagacaccccuggugaaagaaacccuuaugaaaacauacuuuauaaaauuuguuugucaggagauggauggccauauauugcaucaagaaccucaauaacaggaagggccugggaaaacacugucguugaucuagaaucagaugggaagccacagaaggcuggcagcaacaauuccaauaaaucucuacagucggcaggguuugcagcugggcucaccuauucucagcugaugacccucaaggaugcaaugcugcaacuugacccaaaugcuaagaccuggauggacauugaaggaagaccugaagauccaguggaaauugcccucuaucaaccaaguucagguuguuacauacacuucuuccgugaaccuacugauuugaagcaguucaagcaggaugcuaaguacucacaugggauugaugucacagaucucuucgcugcacaaccgggcuugaccagugcuguuaucgaugcacucccccggaauauggucauuaccugucagggguccgaugacauaaggaaacuccuugaaucacaaggaagaaaagacaucaaacuaauugauauugcccucagcaagacugauuccaggaaguaugaaaaugcagucugggaucaauacaaagacuuaugccacaugcacacagguauuguuguagaaaagaagaaaagaggcgguaaagaggaaauaaccccucacugugcacuaauggauugcaucauguuugaugcagcagugucaggagggcugaacacaucgguuuugagagcagugcugcccagagauaugguguucagaacaucaacaccuagagucguccuguaa

SEQ ID NO: 650 - RNA, 1710 nt, Artificial Sequence
  derived and/or modified CDS sequence (wt) from Lassa virus__AIT17381__NP
augagugccucaaaagaaauaaaguccuuuuuguggacacaaucuuugaggagggaauuaucuggcuacugcuccaacaucaaacuucagguggugaaagaugcucaggcucuuuugcauggacuugacuucuccgaagucagcaauguucaacgguugaugcguaaagagagaagggaugacagugauuugaaacgguugagggaccugaaccaagcggucaacaaccuuguugaguuaaaaucaacucaacaaaagagugugcugagaguugggacucuaaccucagaugacuuauuagucuuagcugcugaucuagagaagcugaaaucaaaggugaccaggacagaaaggccauugagcgcaggugucuauaugggcaaccugagcucacagcaacuugaccaaagacgagcucuucugagcaugauaggaaugaguggugguaaucaaggagcucgggcugggagagauggaguggugagaauuugggauguuaaaaaugcagaguugcuuaauaaucaguucgggaccaugccaagucugacacuggcauguuugacaaaacaagggcagguugacuuaaaugaugucgugcaagcauuaacagauuuggguuugaucuacacagcaaaguaccccaacacuucagacuuggacaggcugacucaaagucacccuauucuaaauaugauugacaccaagaaaagcucuuugaacaucucagguuauaauuuuaguuugggugcagcugugaaggcaggagcuugcaugcuagaugguggcaauauguuggagacaauuaaggugucaccucagacaauggaugguauccucaaauccauuuuaaaggucaagaaggcucucgggauguucauuucagacacuccuggugagaggaauccuuaugaaaacauacucuauaagaucuguuugucgggggauggauggccauauauugcaucaagaacuucaauaacaggaagggccugggaaaacacuaucguugaucuggagucggaugggaagccacagaagacuaguaacaccaauuccaacaaaucccuacagucggcaggguuugcugcugggcuaacauauucucagcuuaugacccucaaggaugcaaugcugcaacuugacccaaaugccaagaccuggauggacauugaagggagacccgaagauccaguagaaauugcccucuaucaaccaaguucaggcugcuacauacacuucuuccgugagccuacugauuuaaagcaguucaagcaggaugcuaaauacucacaugggauugaugucacagaccucuuugcugcacaaccaggccugaccagugcuguuauagaugcacucccccggaacaugguuauuaccugucagggguccgaagacauuaggaaacuccuugaaucacaaggaagaaaagacaucaaacuaauugauauugcccucagcaaaacugauuccaggaaguaugagaaugcagucugggaccaguauaaagauuuaugccacaugcauacaggugucguuguugaaaagaagaagaagggcgguaaagaggaaauaacuccccacugugcacuaauggauuguaucauguuugaugcagcagugucaggaggacugaacacaucaguuuugagagcagugcuacccagagacaugguguucagaacaucaacaccuagagucguccuguaa

SEQ ID NO: 651 - RNA, 1710 nt, Artificial Sequence
  derived and/or modified CDS sequence (wt) from Lassa virus__AIT17389__NP
augagugccucaaaggagauaaaguccuucuuguggacacaaucuuugaggagggaacugucugguuauuguuccaauauuaaauuacagguggugaaggaugcccaagcucuuuuacauggacuugauuucucugagguuagcaauguucaacgauugaugcguaaacagagaagggaugauggugaucuaaaacgguugagggaucuuaaucaagcagucaacaaccuuguugaguugaaaucaacucaacaaaagaguguguugagaguugggacuuugaccucagaugacuuguuaauuuuggcugcugaccuagagaagcugaaaucaaaaguaaccagaacagaaaggccguugagcgcagguguuuauauggguaaccugaguucacaacaacuugaccagagacgggcucuccuaaacaugauaggaaugaguggugguaaucaaggggcucggaccgggaaagauggaguggugagaauuugggaugugaaaaaugcggacuugcuuaacaaucaguucgguaccaugccaaguuuaacacuggcaugucuaacaaaacaagggcagguugaccugaaugauguugugcaagcguuaacagauuuggguuugaucuacacagcgaaauaccccaacacuucagacuuagacagguugacucagagccacccuauucuaaauaugauagacaccagcaagagcucccugaacaucucugguuacaauuuuagucugggugcagcuguuaaggcaggggcuugcaugcuagauggugguaacaugcuggagacaaucaagguaucaccucagacaauggauggcauccuuaaguccauucuaaagguuaaaaagagucuugggauguucauaucagacaccccuggcgaaaggaauccuuaugaaaauauacucuauaaaauuugucugucaggagauggguggccguacauugcaucaagaacuucaauaacaggaagggccugggaaaacacugucguugaucuagaaucagaugggaagccacaaaaagcugggagcaacaauuccaacaaaucccuacagucaacaggguucacugccgggcuuaccuauucucagcuuaugacucucaaagaugcaauguugcaacuugauccaaaugcaaagaccuggauggacauugaagggagaccugaggauccgguggaaaucgccuuguaucagccaaguucaggcugcuacauucacuucuuccgugagcccacugauuuaaagcaguucaagcaagaugcuaaguacucacauggaaucgaugugacagaccucuuugcugcacaaccaggcuuaacuagugcugucauagacacacucccucggaacauggucauuaccugccaggggucugaugacauaaggaaacuccuugaaucacagggaagaaaagauaucaaacuaauugacauugcccucaguaaaacugacucaaggaaauaugaaaaugcagucugggaucaguauaaagauuuaugccauaugcacacagguguugucguugagaagaagaaaagaggugguaaagaggaaauaaccccucacugugcucuaauggacugcaucauguuugaugcagcaguuucaggaggacugaaugugucgguucugagagcugugcuaccuagagauaugguguuuagaacaucgacaccuagagucguccuguaa

SEQ ID NO: 652 - RNA, 1710 nt, Artificial Sequence
  derived and/or modified CDS sequence (wt) from Lassa virus__AIT17399__NP
augagugccucaaaggagauaaaguccuuccuguggacacaaucuuugaggagggaauugucugguuacugcuccaacaucaaauuacagguggugaaggaugcccaggcucuuuuacauggacuugacuucucugaagucagcaauguucagcgguuaaugcguaaacagaggagagaugacagugaucuaaaacgauugagggauuuaaaucaagccguuaacaaucuugucgagcugaaaucaacucaacagaagagugugcugagaguugggacucuaaccucagaugacuuguuaguuuuggcugccgaccuagagaagcugaaaucaaaagugauuagaacagaaagaccacuaagcucagguguuuauaugggcaaccugaguucgcaacaacuugaccaaagacgagcucuccugaacaugauaggaaugagugguggcaaucagggggcucaagucgggagagauggaguggugagaguuugggauguaaagaaugcagaucugcucaacaaucaguuuggcaccaugccaagucugacacuggcauguuuaacaaaacaagggcagguugacuugaaugauguagugcaagcacuaacagauuuaggccugaucuacacagcaaaguauccuaacacuucagacuuggacagauuggcucagagccacccuauucuaaacaugauagacaccaaaaaaagcucccuaaacaucucagguuacaauuuuagcuugggcgcagcugugaaagcaggagccugcaugcuggaugguggaaacauguuagagacaaucaaggugacaccucaaacaauggauggcauccugaaguccaucuugaaaguaaaaaaggcccuugggauguucauaucugaaaccccuggcgaaaggaauccuuaugagaauauacucuacaagauuuguuugucaggggauggguggccauauauugcaucaagaaccucaauaacagggagggcuugggaaaacacugucguugaucuggaaucggaugggaaaccacagaaagcugggaacaauaauuccaauaagucccugcagucggcaggauucaccgccgggcuuaccuacucucagcucaugacccucaaggauucaaugcugcagcuugauccaaaugcuaagaccuggauggacauugagggaagacccgaggauccgguggagguugcccuuuaucaaccaaguucaggcugcuacauucacuucuuucgugagccuacugacuugaagcaguuuaagcaagaugcuaaguauucacauggaauugaugucacagaccucuucgcuacacagccagguuugacuagugcuguuauagaggcgcuuccucggaacauggucaucaccugucagggaucugaugacauucgaaagcuccuugaaucacaagggagaaaggauaucaaacuaauugacauugcucucaacaaaacugauucuaggaaguaugagaaugcagucugggaucaguacaaagaccuaugccacaugcacacaggugucguuguugagaagaagaaaagaggugguaaagaggagauaaccccucacugugcccugauggacugcaucauguuugacgcagcagugucagguggauugaaaacacuggcucugagagcagugcuacccagagacaugguguucagaacaucgacaccuaaagucguccuguaa

SEQ ID NO: 653 - RNA, 1710 nt, Artificial Sequence
  derived and/or modified CDS sequence (wt) from Lassa virus__AIT17405__NP
augaguguuucuaaggaagugaagucauuucucuggacacagucauugaggagggagcuuucaggcuauugcuccaacauaaaacuucaaguuguuaaggaugcucaggcucuucuucauggucuugacuuuucugaagucagcaaugugcaacgcuuaaugcgcaagcaaaaaagggaugauagugaucugaaacgccucagagauuugaaucaggcugucaacaaucuuguagaacucaaaucgacacaacaaaagaguaucuugagaguugggaccuugaccucagaugaccugcugacauuggcagcugacuuagagaaacuaaagucgaaggucauuagaacagaaaggccucuaagcucagguguuuauauggggaauuugagcacacagcagcuugagcagagaagggcauugcugaacaugauaggcaugguugguggggcucagggcacccaaccuggaagagacggaguuguuagagugugggauguuaagaauccggaucuuuugaacaaccaguucggcaccaugccuagucugacauuagcaugucucaccaaacaaggucaaguugauuugaaugaugccgucuuagcacuaacagaccugggucuaauauacacagcuaaguacccaaauagcuccgaccuagauagacuuucccaaagccauccuauacugaauaugguggacauuaagaaaagcucccugaacauuucugguuacaacuucagcuuaggagcugcagugaaggcuggggccugcaugcucgauggggggaacauguuggagaccaucaagguuacaccucagacaauggauggcaucuugaagucuauuuuaaaaguaaaaagaucuuugggaauguuuguuucagauacaccuggugagagaaacccuuaugagaacauacuuuacaagaucugucuuuccggugacggcuggcccuacauagcuucaaggacuucuauuguggguagggcuugggagaauaccacuguggaucucgagucagauggaaaaccgcaaaaagugggcucugcuggguccaacaaguccuuacagucagcgggauucccaacagggcugaccuauucucaguugaugacacuuaaagacucaaugaugcagcuugacccaagugccaaaaccuggauagacauugaaggucguccagaagacccuguggaaauagcucuuuaccaaccuaugucgggcuguuacauacacuucuucagagagccaacagacuuaaaacaguucaaacaggaugccaaauauucucaugggauugauguggcagaucuuuucccugcucaaccugguuugaccagcgcaguuauugaggcccucccucgcaauauggugcugaccugucaagguucagaugacauuaagagacucuuagacucccaaggaagaagggacauaaagcuuauugacauugcacugagcaaggcugacucuaggagauuugaaaaugcuguuugggaucaguguaaagaccuaugccauaugcauacuggagugguugucgaaaagaagaaaagaggaggcaaagaagaaauaacuccgcacugugcuuuaauggacugcauaauguaugaugcagcugugucaggagggcucaauauaccaguuuuaagagcaguucuucccagagacaugguguuuagaaccucaagccccaaggucguccuguaa

SEQ ID NO: 654 - RNA, 1710 nt, Artificial Sequence
  derived and/or modified CDS sequence (wt) from Lassa virus__AIT17409__NP
augagcgcuucuaaggaagugaagucauuucucuggacacagucauugaggagggagcuuucagguuauugcuccaacauaaagcuucaaguuguuaaggaugcucaggcucuccuucauggucuugacuuuucugaaguuagcaaugugcagcgcuugaugcgcaaacaaaagagggaugauggugaucugaaacgucuaagagaucugaaucaggcugucaacaaucuuguagaacucaaaucaacacaacaaaagaguaucuugagaguugggaccuugaccucagaugaucugcugacauuggcagcugacuuagagaaacuaaagucgaaggucaucagaacagaaaggccacuaagcucagguguuuacauggggaauuugaguacacagcaacuugagcaaagaagggcauugcugaacaugauaggcaugguugguggggcucaaggcacccaaccugggagagacggaguuguuagggugugggauguuaagaauccagaucuuuugaacaaccaguucggcaccaugccuagucugacauuagcaugucucacuaaacagggucagguugauuugaaugaugccgucuuagcacuaacagaccugggucuaauauacacagcuaaguacccuaauagcuccgaccuggacagacuuucccaaagccauccuauauugaauaugguggacacuaagaagagcuccuugaacaucucugguuauaacuuuagcuuaggagcugcagugaaagcuggagcuuguaugcuugauggggggaacauguuggagaccaucaagguuacaccucagacaauggauggcaucuugaagucuauuuuaaaggugaaaaaauccuugggaauguuuguuucagauacaccuggugagaggaacccuuaugagaacauacuuuacaagaucugucuuuccggugacggcuggcccuacaucgcuucaaggacuucuauuguggguagagcuugggagaauacuacuguagaucucgagucagaugggaaaccacaaaaagugggaacugcuggguccaacaagucuuuacagucagcgggguuuccaacagggcugacuuauucucaguugaugacacucaaagauucaaugaugcagcuugacccaagugccaaaaccuggauagacauugaaggucguccagaagacccuguggaaauagcucuuuaccagccuaugucaggcugcuauauacacuucuucagagaaccaacagacuuaaaacaguucaagcaagaugccaaauauucucaugggauugaugugacagaucuuuucucugcucaaccuggauuaaccagugcagucauugaagcccucccucgcaauaugguacugaccugucaagguucagaugauauuaagcgacucuuggauucccaaggaagaagggauauaaagcuuauugacauugcacugaacaaggcugacucuaggagauuugaaaaugcuguuugggaucagugcaaagaucuaugccauaugcacacuggagugguugucgaaaagaagaaaagaggaggcaaagaagaaauuaccccacacugugcucuaauggacugcauaauguacgaugcagcugugucaggaggccucaauauaccaguuuugagagcaguccuccccagggacaugguguuuagaaccucaagccccaaagucguccuguaa

SEQ ID NO: 655 - RNA, 1710 nt, Artificial Sequence
  derived and/or modified CDS sequence (wt) from Lassa virus__AIT17413__NP
augagugcuuccaaagaaguaaagucauuccuuuggacacagucauugaggagggagcucucagguuacugcuccagcauaaagcuucaaguugucaaggaugcucaggcccuccuucauggucuugacuuuucugaagucaguaauguucagcgcuugaugcgcaaacaaaaaagggacgacagugaucugaaacgucucagagaucugaaccaggcugucaacaaucuuguagaacucaaaucaacacaacaaaagaguauucugagaguugggaccuugaccucagaugaucugcugacauuggcagcugacuuggagaaacuuaagucgaaggucaucagaacagaaaggccacuaagcucagguguuuacaugggaaaucugaguacacagcaacuugagcaaagaagagcauugcuaaacaugauaggcaugguugguggggcucaggguacccaaccuggaagagacggaguuguuagggugugggaugucaagaauccggaucuuuugaacaaccaauucggcaccaugccuagucugacauuagcaugucucaccaaacaaggucaaguugauuuaaaugaugccgucuuggcacuaacagaccugggucuaauauacacagcuaaguacccaaacagcuccgaccuggacagacuuucucaaagccauccuauacugaacaugguggacacuaagaagagcuccuugaacauuucugguuacaacuucaguuuaggagcugcagugaaagcuggagccuguaugcuugauggggggaacauguuggagaccaucaagguuacaccucaaacaauggauggcaucuugaaaucuauccuaaagguaaaaagaucuuugggaauguuuguuucagaugcaccuggugagaggaacccuuaugagaacauacuuuacaaaaucugucuuucuggagacgguuggcccuacauagcuucaagaacuuccauuguggguagagcuugggagaacaccacuguggaucucgagucagauggaaaaccacaaaagauggguacugcuggguccaacaagucuuuacagucagcgggguuuccaacaggguuaaccuacucucaguugaugacacuuaaagacucaaugaugcaacuugacccaagugcuaaaaccuggauagacauugaaggucguccagaagacccuguggaaauagcucuuuaccaaccuaugucggguuguuacauacacuucuucagagaaccaacagacuugaaacaguucaagcaagaugccaaauauucucaugggauugauguggcagaucuuuucccugcucaaccuggcuugaccagugcagucauugaagcccuuccucgcaauaugguacugaccugucaggguucagacgauaucaagaaacucuuagauucacaaggaagaagggacauaaagcuuauugacauugcacugagcaaggcugacucuaggagguuugagaaugcuguuugggaucaaugcaaggaucugugccauaugcauacuggggugguuguugagaaaaagaaaagaggaggcaaagaagaaauuaccccacacugugcucuaauggauugcauaauguaugaugcagcugugucaggaggacucaauauaccaguuuugagagcaguucuccccagagacaugguguuuagaacaucaagccccaaggucguccuguaa

SEQ ID NO: 656 - RNA, 1710 nt, Artificial Sequence
  derived and/or modified CDS sequence (wt) from Lassa virus__AIT17421__NP
augagugcuuccaaggaagugaagucauuucucuggacacagucauugaggagggagcuuucaggcuauugcuccaacauaaaacuucaaguuguuaaggaugcucaggcucuucuucauggucuugacuuuucugaagucagcaaugugcagcgcuuaaugcgcaagcaaaaaagggaugauagugaucugaaacgucucagagauuugaaucaggcugucaacaaucuuguagaacucaaaucgacacaacaaaagaguaucuugagaguugggaccuugacuucagaugaccugcugacauuggcagcugacuuagagaaacuaaagucgaaggucauuagaacagaaaggccucuaagcucagguguuuacauggggaauuugagcacacagcagcuugagcagagaagagcauugcugaacaugauaggcaugguuaguggggcucagggcacccaaccuggaagagacggaguuguuagggugugggauguuaagaauccggaucuuuugaacaaccaguucggcaccaugccuagucugacauuagcaugucucaccaaacaaggucaaguugauuugaaugaugccgucuuagcacuaacagaccugggucuaauauacacagcuaaguacccaaauagcuccgaccuagauagacucucccaaagccauccuauacugaauaugguggacauuaagaaaagcucccugaacauuucugguuacaacuucagcuuaggagcugcagugaaggcuggagccugcaugcucgauggggggaacauguuggagaccaucaagguuacaccucagacaauggauggcaucuugaagucuauuuuaaaagugaaaagaucuuuggggauguuuguuucagauacaccuggugagagaaacccuuaugagaacauacuuuacaagaucugucuuuccggugacggcuggcccuacauagcuucaaggacuucuauuguggguagggcuugggagaauacuacuguggaucucgagucagauggaaaaccgcaaaaaaugggcucugcuggguccaacaaguccuuacagucagcgggauucccaacagggcugaccuauucucaguugaugacacuuaaagacucaaugaugcagcuugacccaagugccaaaaccuggauagacauugaaggucguccagaagacccuguggaaauagcucuuuaccaaccuaugucgggcuguuacauacacuucuucagagagccaacagacuuaaaacaguucaagcaggaugccaaauauucucaugggauugauguggcagaucuuuucccugcucaaccugguuugaccagcgcaguuauugaagcccucccucgcaauauggugcugaccugucaagguucagaugauauuaagagacucuuagacucccaaggaagaagggacauaaagcuuauugacauugcacugagcaaggcugacucuaggagauuugaaaaugcuguuugggaucaguguaaagaccuaugccauaugcauacuggagugguugucgaaaagaagaaaagaggaggcaaagaagaaauaacuccgcacugugcuuuaauggacugcauaauguaugaugcagcugugucaggagggcucaauauaccaguuuuaagagcaguucuucccagagacaugguguuuagaaccucaagccccaaggucguccuguaa

SEQ ID NO: 657 - RNA, 1710 nt, Artificial Sequence
  derived and/or modified CDS sequence (wt) from Lassa virus__AIT17425__NP
augagugcuucuaaggaaguaaagucauuccucuggacacagucauugagaagggaacuuucagguuauugcuccagcauaaagcuucaaguuguuaaagaugcucaggcucuccuucauggucuugacuuuucugaagucagcaaugugcagcgccuaaugcgcaaacaaaaaagggaugauagugaucugaaacgucucagagaucugaaucaggcugucaacaaucuuguggaacucaaaucaacacaacaaaagaguaucuugagaguugggaccuuaaccucagaugaccuguugacauuggcagcugacuuagagaaacuaaagucaaaggucauuagaacagaaagaccacugagcucagguguuuauauggggaauuugagcacacagcagcuugagcaaaggagagcacuauugaacaugauaggcaugguugguggggcucagggcacccaaccuggaagggacggaguuguuagggugugggauguuaaaaauccggaucuuuugaacaaccaguuuggcaccaugccuagucugacauuggcaugucucacuaaacaaggucaaguugauuugaaugaugccgucuuagcacuaacagaccugggucugauauauacagcuaaguacccaaauagcuccgaccuggacagacuuucccaaagucauccuauacugaacaugguggacacuaagaaaagcuccuugaacauuucugguuacaacuucagcuuaggagcugcagugaaagcuggagcuuguaugcuugauggggggaacauguuggagaccaucaagguuacaccucagacaauggauggcauccugaagucuauuuuaaagguaaaaaaauccuugggaauguuuguuucagauacaccuggggagaggaacccuuaugagaacauacuuuacaaaaucugucuuuccggugacggcuggcccuacauagcuucuaggacuuccauugugggcagagcuugggagaauaccaucguggaucucgagucagauggaaaaccacaaaaagugggcacugcugggucuaacaagucuuuacagucagcgggguuuccaacagggcugaccuauucucaguugaugacacuuaaagacucaaugaugcagcuugacccaagugccaaaaccuggauagacauugaaggucguccagaggacccuguggaaauagcucuuuaccaaccuaugucgggcuguuauauacacuucuucagagaaccaacagacuuaaaacaguucaaacaagaugccaaauauucucaugggauugauguagcagaucuuuucccugcucaaccuggcuugaccagugcagucauugaagcccuuccccgcaauauggugcugaccugucaagguucagaugauauuaagagacucuuggauucucaagggagaagggacauaaagcuuauugacauugcacugagcaaggcugacucuagaagauuugaaaaugcuguuugggaucagugcaaagaucuaugccauaugcacacuggaguggucgucgaaaagaagaaaagagggggcaaagaagaaauuaccccgcauugugcuuuaauggacuguauaauguaugaugcagcugugucaggaggacucaauauaccaguuuuaagagcaguucuccccagagauaugguguuuagaaccucaagccccaaggucguccuguaa

SEQ ID NO: 658 - RNA, 1710 nt, Artificial Sequence
  derived and/or modified CDS sequence (wt) from Lassa virus__AIT17429__NP
augagugcuucuaaggaagugaagucauuccucuggacacagucauugaggagggagcuuucagguuauugcuccaacauaaagcuucaaguuguuaaggaugcucaggcucuccuucauggucuugacuuuucugaagucagcaaugugcagcgcuuaaugcgcaaacaaaagagggaugauagugaucugaaacgucucagagauuugaaucaggcugucaacaaucuuguagaacucaagucgacacaacaaaagagcaucuugagaguugggaccuugaccucagaugaccugcugacauuggcagcugaccuggagaaacugaagucgaaggucauuagaacagaaaggccauuaagcucagguguuuauauggggaauuuaagugcacagcagcuugagcaaagaagagcauugcugaacaugauaggcaugguugguggggcucaggguacucaaccugggagagacggaguuguuagggugugggauguuaagaauccggaucuuuugaacaaucaguucggcaccaugccuagucugacacuagcaugucucaccaaacaaggucagguugauuugaaugaugcugucuuagcacuaacagaccuggguuuaauauacacagcuaaguauccaaauagcuccgauuuagacagacuuucccaaagccaucccauauugaauaugguggacacaaagaagagcuccuugaacauuucugguuacaacuucagcuuaggggcugcagugaaagcuggagcuuguaugcuugauggggggaacauguuggagaccauuaagguuacaccucagacaauggauggcaucuugaagucuauuuuaaagguuaaaagaucuuugggaauguuuguaucagaugcaccuggugagaggaacccuuacgagaauauacucuacaagaucugucuuuccggugacggcuggcccuauauagcuucaagaacuucuauuguggguagagcuugggagaacacuacuguggaucucgaaucagaugggaaaccacaaaaaguggguacugccggguccaacaaaucucuacagucagcgggguuuccaacagggcugaccuauucucaguuaaugacacuuaaagacucaaugaugcagcuugacccgagugccaaaaccuggauagacauugaaggucguccagaagacccuguggaaauagcucuuuaccaaccuaugucgggcuguuacauacacuucuucagagaaccaacagauuuaaaacaguucaaacaagaugccaaauauucucaugggauugauguggcagaucuuuucccugcucaaccugguuuaaccagugcagucauugaagcucucccucgcaauaugguauuaaccugucaagguucagaugauaucaagagacucuuggacucccaaggaaggagggacauaaagcuuauugacauugcacugagcaaggcugacucuaggagauuugaaaaugcuguuugggaucagugcaaagaucuaugucauaugcauacuggagugguugucgaaaagaagaaaagaggaggcaaagaagaaauuaccccacacugugcuuuaauggacugcauaauguaugaugcagcugugucaggaggacucaauauaccaguuuuaagagcaguucuuccuagggacaugguguuuagaaccucaagccccaaggucguccuguaa

SEQ ID NO: 659 - RNA, 1710 nt, Artificial Sequence
  derived and/or modified CDS sequence (wt) from Lassa virus__AIT17431__NP
augagugcuucuaaggaagugaagucauuucucuggacacagucauugaggagggagcuuucagguuauuguucuaacauaaaacuucaaguuguuaaggaugcucaggcucuccuucauggucuugacuuuucugaagucagcaaugugcagcgcuuaaugcgcaaacaaaaaagagacgauagugaucugaaacgucucagagauuugaaucaggcugucaacaaucuuguagaacucaaaucgacacaacaaaagaguaucuugagaguugggaccuugaccucagaugaccugcugacauuggcagcugacuuagagaaacuaaagucgaaggucauuagaacagagaggccacuaagcucagguguuuauauggggaauuugaguacacagcagcuugagcagagaagagcauugcugaacaugauaggcaugguugguggggcucagggcacccaaccuggaagagacggaguuguuagggugugggauguuaagaauccggaucuuuuaaauaaccaguucggcaccaugccuagucugacauuagcaugucuaaccaaacaaggucaaguugauuugaaugaugccgucuuagcacuaacagaccugggccuaauauacacagcuaaguacccaaauagcuccgaccuggacagacuuucccaaagccaucccauacugaauaugguggacacuaagaaaagcuccuugaauauuucugguuucaacuucagcuuaggagcugcagugaaagcuggggcuuguaugcuugauggagggaacauguuggagaccaucaagguuacaccucagacaauggauggcaucuugaagucuauuuuaaagguaaaaaagucuuugggaauguuuguuucagauacacccggugagaggaacccuuaugagaacauacuuuacaagaucugucuuucuggugacggcuggccuuacauagcuucaaggacuucuauuguggguagagcuugggagaauacuacuguggaucucgagucagaugggaaaccgcaaaaagugggcacugcuggguccaacaagucuuuacagucagcaggguucccaacagggcugaccuauucucaguugaugacacuuaaagacucaaugaugcagcuugacccaagugccaaaaccuggauagacauugaaggucgcccagaagacccuguggaaauagcucuuuaccaaccuaugucaggcuguuacauacacuucuucagagaaccaacagacuuaaaacaguucaagcaggaugccaaauauucucauggaauugauguggcagaucuuuucccugcucaaccugguuugaccagcgcagucauugaagcccucccucgcaauaugguacugaccugucaagguucagaugauauuaagagacucuuggauucccaaggaagaagggacauaaagcuuauugacauugcacugagcaaggcugauucuaggagauuugaaaaugcuguuugggaucagugcaaagaccuaugccauaugcauacuggagugguugucgaaaagaagaaaagaggaggcaaagaagaaauaaccccgcacugugcuuuaauggacugcauaauguaugaugcagcugugucaggaggacucaauauaccaguuuuaagagcaguucuccccagggacaugguguuuagaaccgcaagccccaaggucguccuguaa

SEQ ID NO: 660 - RNA, 1710 nt, Artificial Sequence
  derived and/or modified CDS sequence (wt) from Lassa virus__AIT17439__NP
augagugcuucuaaggaagugaagucuuuucucuggacacagucauugaggagggagcuuucagguuauugcuccagcauaaaacuucaaguuguuaaagaugcucaggcucuccuucauggucuugacuuuucugaagucagcaaugugcagcgcuuaaugcgcaaacagaagagggaugauagugaucugaaacgucucagagauuugaaucaggccgucaacaaucuuguagaacucaaaucgacacaacaaaagagcaucuugagaguugggaccuugacuucagaugaccugcugacauuggcagcugacuuagagaaacuaaagucgaaggucauuagaacagaaaggccacuaagcucagguguuuauaugggaaauuugaguacacagcagcuugagcaaagaagagcacugcugaacaugauaggcaugguugguggggcucagggcacccaaccuggaagagacggaguuguuagggugugggauguuaagaauccggaucuuuugaacaaucaguucggcaccaugccuagucugacauuagcaugucucaccaaacaaggucaaguugauuugaaugaugcugucuuagcacuaacagaccugggucuaauauacacagcuaaguauccaaauagcucugaccuagauagacuuucucaaagccauccuauucugaauaugguggauacuaagaagagcuccuugaauauuucugguuucaacuucaguuuaggagcugcagugaaagcuggagcuuguaugcuugauggggggaacauguuggagaccauuaagguuacaccucagacaauggauggcaucuuaaagucuauuuuaaaggugaagagaucuuugggaauguuuguuucagacacaccuggugagaggaacccuuacgagaacauacuuuacaagaucugucuuuccggugacggcuggcccuacauagcuucaaggacuuccauuguagguagagcuugggagaauacuacuguggaucucgagucagaugggaaaccacaaaaaauggguacugcuggguccaauaagucuuuacagucagcaggguuuccaacagggcugaccuauucucaguugaugacacuuaaagacucaaugaugcagcuugacccaagugccaaaaccuggauagacauugaaggucgaccagaagacccuguagaaauagcucuuuaccaaccugugucgggcuguuacauacacuucuucagagagccaacagauuuaaaacaguucaaacaagaugccaaauauucucaugggauugauguggcagaucuuuucucugcucaaccugguuugaccagugcagucauugaagcucucccucgcaauaugguacugaccugucaagguucagaugauauuaagagacucuuggacucccaaggaagaagggauauaaagcuuauugacauugcacugagcaaggcugacucuaggagauuugaaaaugcuguuugggaucagugcaaagauuuaugccauaugcauacuggagugguugucgaaaagaagaaaagaggaggcaaagaagaaauuacuccgcacugugccuuaauggacugcauaauguaugaugcagcugugucaggaggacucaauauaccaguuuuuagagcaguucuccccagagacaugguguuuagaaccucaagccccaaggucgucuuguaa

SEQ ID NO: 661 - RNA, 1710 nt, Artificial Sequence
  derived and/or modified CDS sequence (wt) from Lassa virus__AIT17443__NP
augagugcuuccaaggaaguaaagucauuccuuuggacacagucauugaggagggagcucucagguuacugcuccagcauaaagcuucagguuguuaaggaugcucaggcucuccuucauggucuugacuuuucugaagucagcaauguucagcgcuugaugcgcaaacaaaaaagggacgacagugaucugaaacgucucagagaucugaaccaggcugucaacaaucuuguagaacucaaaucaacacaacaaaagaguauccugagaguugggaccuugacuucagaugaccugcugacauuggcagcugacuuagagaaacuaaagucaaaggucaucagaacagaaaggccacuaagcucagguguuuacaugggaaauuugaguacacagcaacuugagcaaagaagagcauuacugaacaugauaggcaugguugguggggcucaggguacccaaccuggaagggacggaguuguuagggugugggaugucaagaauccggaucuuuugaacaaccaauucggcaccaugccuagucugacauuagcaugucucaccaaacaaggucaaguugauuuaaaugaugccgucuuagcacuaacagaccugggucuaauauacacagcuaaguacccaaacaguuccgaccuggacagacuuucccaaagccauccuauacugaauaugguggacacuaagaagagcuccuugaauauuucugguuacaacuucaguuuaggagcugcagugaaagcuggagccuguaugcuugauggggggaacauguuggagaccaucaagguuacaccucagacaauggauggcaucuugaaaucuaucuuaaagguaaaaagaucuuugggaauguuuguuucagaugcaccuggugagaggaacccuuaugagaacauacuuuacaagaucugucuuucuggggacgguuggcccuacauagcuucaagaacuuccauuguagguagagcuugggagaacaccacuguggaucucgagucagauggaaagccacaaaaggugggcacugcuggguccaacaagucuuuacagucagcaggguuuccaacaggguugaccuauucucaguugaugacacuuaaagacucaaugaugcaacuugacccaagugcuaaaaccuggauagacauugaaggucguccagaagacccuguggaaauagcucuuuaccaaccuaugucgggcuguuacauacacuucuucagagaaccaacagauuugaaacaguucaagcaagaugccaaauauucucaugggauugauguagcagaucuuuucccugcucaaccuggcuugaccagugcagucauugaagcccuuccucgcaauaugguacugaccugucaggguucagaugauauuaagaaacucuuagacucccaaggaagaagggacauaaagcuuauugacauugcacugagcaaggcugacucuaggagguuugagaaugcuguuugggaucaaugcaaggaucuaugccauaugcauacuggggugguuguugaaaagaagaaaagaggagguaaagaagaaauuaccccacacugugcucuaauggauugcauaauguaugaugcggcugugucaggaggacucaauauaccaguuuugagagcaguucuccccagagacaugguguucagaacaucaagccccaaggucguccuguaa

SEQ ID NO: 662 - RNA, 1710 nt, Artificial Sequence
  derived and/or modified CDS sequence (wt) from Lassa virus__AIT17447__NP
augagugcuuccaaggaagugaagucauuucucuggacacagucauugaggagggagcuuucagguuauugcuccaacauaaagcuucaaguugucaaggaugcucaagcucuccuucauggucuugacuuuucugaaguuagcaauguacagcgcuugaugcgcaaacaaaaaagagaugauagugaucugaaacgccucagagaucugaaucaggcugucaacaaucuuguagaacucaaaucaacacaacaaaagaguaucuugagaguugggaccuugaccucagaugaccugcugacacuggcagcugaccuagagaaacuaaaaucgaaggucauuagaacagaaaggccacuaagcucagguguuuauauggggaacuugaguacacagcaacuugagcaaagaagagcauugcugaacaugauaggcaugguugguggagcucagggcacccaaccuggaagagacggaguuguuagggugugggaugucaagaauccagaucuuuugaacaaccaguucggcaccaugcccagucugacauuagcaugucucacuaaacaaggucagguugauuugaaugaugccgucuuagcacuaacagaucugggucugauauacacagcuaaguaccccaauagcuccgaccuggacagacuuucccaaagccauccuauauugaauaugguggacaccaagaagagcuccuugaacauuucugguuacaacuuuagcuuaggagcugcggugaaagcuggagcuuguaugcuugauggggggaacauguuggagaccaucaagguuacaccucagacaauggauggcaucuugaaguccauuuuaaagguaaaaaaauccuugggaauguuuguuucagauacaccuggugaaaggaacccuuaugagaacauacuuuacaagaucugucuuuccggugacggcuggcccuacauagcuucaaggacuucuauuguggguagagcuugggagaauacuacuguagaucucgagucagauggaaaaccacaaaaagugggaacuacuggguccaacaagucuuuacagucagcgggguuuccaacagggcugacuuauucucaguugaugacacuuaaagacucaaugaugcagcuugacccaagugccaagaccuggauagacauugaaggucguccagaagacccuguggaaauagcucuuuaccagccuaugucgggcugcuauauacacuucuucagagaaccaacagauuuaaagcaguucaagcaagaugccaaauauucucaugggauugauguaacagaucuuuucccugcucagccuggauugaccagugcaguuauugaggcccucccucgcaauaugguacugaccugucaggguucagaugacauuaagcgacucuuggauucccaaggaagaagggacauaaagcuuauugacaucgcacugagcaaggcugauucuaggagauuugaaaaugcuguuugggaucagugcaaagaucuaugccacaugcacacuggagugguugucgaaaagaagaaaagaggagguaaagaagaaauuaccccacacugugcucuaauggacugcauaauguaugaugcagcugugucaggaggacucaauauaccgguuuuaagggcaguccuccccagagacaugguguuuagaaccucaagucccaaggucguccuguaa

SEQ ID NO: 663 - RNA, 1710 nt, Artificial Sequence
  derived and/or modified CDS sequence (wt) from Lassa virus__AIT17451__NP
augagugcuucuaaggaagugaagucauuccucuggacacagucauugaggagggagcuuucagguuacugcuccaacauaaaacuucaaguuguuaaggaugcucaggcucuccuucauggucuugacuuuucugaagucagcaaugugcagcgcuuaaugcgcaaacaaaaaagggaugacagugaucugaaacgucucagagauuugaaucaggcugucaacaaucuuguagaacucaaaucgacacaacaaaagaguaucuugagaguugggaccuugaccucagaugaccugcugacauuggcagcugacuuagagaaacuaaagucgaaggucauuagaacagaaaggccacuaagcucagguguuuauauggggaauuugagcacacagcagcuugagcagagaagagcauugcugaacaugauaggcaugguugguggggcucagggcacccaaccugggagagacggaguugugagggugugggauguuaagaauccagaccuuuugaacaaccaguucggcaccaugccuagucugacauuagcaugucucaccaaacaaggucaaguugauuugaaugaugccgucuuggcacuaacagaccugggucuaauauauacagcuaaguucccaaauagcucugaccuggauagacuuucccaaagccauccuauacugaauaugguggacacuaagaaaagcuccuuaaacauuucugguuacaacuucagcuuaggagcugcaguaaaagcuggagcuuguaugcuugauggggggaacauguuggagaccaucaagguuacaccucagacaauggauggcaucuugaagucuauuuuaaagguaaaaaaaucuuuggggauguuuguuucagauacaccuggugagaggaacccuuaugagaacauacuuuacaagaucugucuuuccggugacggcuggcccuacauagcuucaagaacuucuauuguggguagagcuugggagaauacuacuguggaucucgagucagauggaaaaccgcaaaaagugggcacuacuggguccaacaagucuuuacagucagcgggguucccaacagggcugaccuacucucaguugaugacacuuaaagacucaaugaugcagcuugacccaagugccaaaacuuggauagacauugaaggucguccagaagacccuguggaaauagcucuuuaccaaccuaugucaggcuguuauauacacuuuuucagagagccaacagacuuaaaacaguucaagcaagaugccaaauauucucaugggauugauguggcagaucuuuucccugcucaaccugguuugaccagcgcagucauugaagcccucccucgcaauauggugcugaccugccaagguucagaugauauuaagagacucuuggacucccaaggaaggagggauauaaaacuuauugacauugcacugagcaaggcugacucuaggagauuugaaaaugcuguuugggaucaaugcaaagaucuaugccauaugcacacuggagugguggucgaaaagaagaaaagagggggcaaagaggagaucaccccgcacugugcuuuaauggacugcauaauguaugaugcagcugugucaggaggacucaauauaccaguuuuaagagcaguucuccccagggacaugguguuuagaacuucaagccccaaggucguccuguaa

SEQ ID NO: 664 - RNA, 1710 nt, Artificial Sequence
  derived and/or modified CDS sequence (wt) from Lassa virus__AIT17455__NP
augagugcuucuaaggaagugaagucauuucucuggacacagucauugaggagggagcuuucagguuauugcuccagcauaaagcuucaaguuguuaaggaugcucaggcucuucuucauggucuugacuuuucugaagucagcaaugugcagcgcuuaaugcgcaagcaaaaaagagaugacagugaucuaaaacgucucagagaucugaaucaggcugucaacaaucuuguagaacucaaaucaacacaacagaagagugucuugagaguugggaccuugaccucagaugaucugcugacauuggcagccgacuuagagaaacuaaagucgaaggucauuagaacagaaaggccacuuagcucagguguuuauauggggaaccugagcacacagcagcuugagcaaagaagagcauugcugagcaugauaggcaugguugguggggcucagggcacccaaccuggaagagauggaguuguuagggugugggaugucaagaauccggaucuuuugaacaaccaauucggcaccaugccuagucugacauuagcaugccucaccaaacaaggucaaguugauuugaaugaugccgucuuagcacuaacagaccugggucuaauauauacagcuaaguacccaaauagcucugaucuggacagacuuucccaaagccauccuauacugaauaugguggacacuaagaagagcuccuugaacauuucugguuacaacuucagcuuaggggcugcagugaaagcuggagcuuguaugcuugaugggggaaacauguuggagaccaucaaggucacaccccagacuauggauggcauccugaagucaauuuugaaggugaaaagauccuugggaauguuuguuucagauacaccuggugaaaggaacccuuaugagaauauacuuuauaagaucugucucucuggugacgguuggcccuauauagcuucaaggacuucuauuguggguagagcuugggagaauacuacuguggaucucgagucagacgggaaaccacaaaaagugggcacugcugggucuaacaagucuuuacagucagcgggguuuccaacagggcugaccuauucucaguugaugacacuuaaagacucaaugaugcagcuugacccaagugccaaaaccuggauagacauugaaggucguccagaagacccuguggaaauagcucuuuaccaaccuaugucagguuguuacauacacuucuucagagaaccaacagacuuaaaacaguucaagcaggaugcuaaauacucucaugggauugauguagcagaucuuuucccugcucaaccugguuugaccagugcagucauugaagcccucccucgcaauauggugcugaccugucaagguucagaugauauuaagagacuccuggacucccaaggaaggagggacauaaaacucauugacauugcacugagcaaggcugacuccaggagauuugaaaaugcuguuugggaucagugcaaagaucuaugccauaugcauacuggagugguuguugaaaagaagaaaagaggaggcaaagaagaaauuaccccgcacugugcucugauggacugcauaauguaugaugcagcugugucaggaggacucaauauaccaguucugagagcaguucuccccagagacaugguguuuagaaccucaagccccaaggucguccuguaa

SEQ ID NO: 665 - RNA, 1710 nt, Artificial Sequence
  derived and/or modified CDS sequence (wt) from Lassa virus__AIT17459__NP
augagugcuucuaaggaagugaagucauuucucuggacacagucauugaggagggagcuuucagguuauugcuccagcauaaaacuucaaguuguuaaggaugcucaggcucuccuucauggucuugacuuuucugaggucagcaaugugcagcgcuuaaugcgcaaacaaaagagggaugauagugaucugaaacgucucagagauuugaaucaggcugucaacaaucuuguagaacucaaaucgacacaacaaaagagcaucuugagaguugggaccuugaccucggaugaccugcugacauuggcagccgaccuggaaaaacuaaagucgaaggucauuagaacagaaaggccacuaagcucagguguuuauauggggaauuugaguacacagcaacuugagcaaagaagagcauugcugaacaugauaggcaugguuggcggggcccaggguacccaaccuggaagggacggaguuguuagagugugggauguuaagaauccggaucuuuugaacaaucaguucggcaccaugccuagucugacauuagcaugucucaccaaacaaggccaaguugauuugaaugaugcugucuuagcacuaacagaucugggucuaauauacacagcuaaguauccaaauagcuccgaccuggacagacuuucccaaagccacccuauacugaauaugguggacacuaagaagagcucccugaacauuucuggcuacaacuucagcuuaggagcugcagugaaagcuggagcuuguaugcuugaugggggaaacauguuggagaccauuaagguuacaccucagacaauggauggcaucuugaagucuaucuuaaagguaaaaagaucuuugggaauguuuguuucagauacaccuggugagaggaacccuuacgaaaacauacuuuacaagaucugucuuucuggcgacggcuggcccuacauagcuucaaggacuucuauuguggguagagcuugggagaauacuacuguggaucucgagucagauggaaaaccacagaaaaugggcacugcuggguccaacaagucuuuacagucagcaggguuuccaacagggcugaccuauucucaguugaugacacuuaaagacucgaugaugcagcuugacccaagugccaaaaccuggauagacauugaaggucguccagaagacccuguggaaauagcucuuuaccaaccugugucuggcuguuacauacacuucuucagagaaccaacagauuuaaaacaguucaagcaagaugccaaguauucucaugggauugauguggcagaucuuuucccugcucaaccugguuugaccagugcagucauugaagcucucccucgcaauaugguacugaccugucaagguucagaugauauuaagagacucuuggauucccaaggaagaagggacauaaagcuuauugacauugcacugagcaaggcugauucuaggagauuugaaaaugcuguuugggaucagugcaaagaucuaugccauaugcauacuggggugguugucgaaaagaagaaaagaggaggcaaagaagaaauuaccccgcacugugcuuuaauggacugcauaauguaugaugcagcugugucaggaggacucaauauaccaguucuaagagcaguucuccccagagacaugguguuuagaaccucaagccccaaagucguccuguaa

SEQ ID NO: 666 - RNA, 1710 nt, Artificial Sequence
  derived and/or modified CDS sequence (wt) from Lassa virus__AIT17463__NP
augagugcuuccaaggaagugaagucauuccuuuggacacagucauugaggagggaacucucagguuacugcuccagcauaaagcuccaaguuguuaaggaugcucaggcucuccuucauggucuugacuuuucugaagucagcaaugugcaacgcuuaaugcgcaagcauaaaagggacgauagugaucugaaacgucucagagaccugaaucaggcugucaacaaucuuguagaacucaaaucaacacaacaaaagaguaucuugagaguugggaccuugaccucagaugaccuacugacauuggcagcugaccuagagaaacuaaaaucaaagguuaucagaacagaaaggccacuaagcucagguguauauauggggaaucugaguacacagcaacuugagcaaagaagagcauugcugaacaugauaggcaugguugguggggcucagagcacccaaccuggaagagacggaguugucagggugugggaugucaagaauccggaucuucugaacaaccaauucggcaccaugccuagucugacauuggcaugucucaccaaacaaggucaaguugauuuaaaugaugccguuuuagcacuaacagaccugggucuaauauacacagcuaaguauccaaacaguuccgaccuggacagacuuucucaaagccauccuauacugacuaugguggacacuaagaagagcuccuugaacauuucugguuuuaacuucagcuuaggagcugcagugaaagcuggggcuuguaugcuugauggggggaacauguuggagaccaucaaaguuacaccucagacaauggauggcaucuugaagucuauuuuaaaggugaagaaaucuuugggaauguuuguuucagauacaccuggugagaggaacccuuaugagaacauacucuacaagaucugccuuucuggugacggcuggcccuacauagccucaagaacuucuauuguggguagggcuugggagaauacuauuguggaccuugagacagacgggaagccacaaaaaguggguacugcuggguccagcagguccuuacagucagcaggguuuccaacaggauugaccuauucucaguugaugacacuuaaagacucaaugaugcagcuugacccaagugccaaaacuuggauagacauugagggucguccagaagacccuguggaaauagcucuuuaccaacccaugucgggcuguuacauacacuucuucagagaaccaacagacuuaaaacaguucaagcaggaugccaaauauucucaugggauugauguagcagaucuuuucccugcucaaccuggcuuaaccagugcugucauugaagcccuuccucgcaauauggugcugacuugucaaggcucagaugauauuaagaaacucuuagauucccaaggaagaagggacauaaagcuuauugacauugcacugagcaaggcugacucuaggagauuugaaaaugcuguuugggaucagugcaaagaucuaugccacaugcauacuggggugguugucgaaaagaagaagagagggggcaaagaagaaauuaccccacacugugcucuaauggacugcauaauguaugaugcagcugugucaggaggacuuaauauaccaguuuuaagagcaguucuccccagagacaugguguuuagaaccucaagccccaaggucguccuguaa

SEQ ID NO: 667 - RNA, 1710 nt, Artificial Sequence
  derived and/or modified CDS sequence (wt) from Lassa virus__AIT17467__NP
augagugcuucuaaggaagugaagucauuucucuggacacagucauuaaggagggagcuuucagguuauugcuccagcauaaagcuucaaguuguuaaagaugcucaggcucuccuucauggucuugacuuuucugaagucagcaaugugcagcguuugaugcgcaaacaaaaaagggaugauagugaucugaaacgucucagagaucugaaucaggcugucaacaaucuuguugaacucaaaucaacacaacaaaaaaguauccugagaguugggaccuugacuucagaugaccugcugacauuggcagccgacuuagagaaacuaaagucgaaggucauuaggacagaaaggccacugagcucagguguuuauauggggaauuugagcacacagcagcuugaacaaagaagagcauuguugaacaugauaggcaugguuggugggacucagggcacccaaccuggaagagacggaguuguuagggugugggauguuaagaauccagaucuuuugaacaaccaguucggcaccaugccuaguuugacauuagcaugucucaccaaacaaggucaaguugaucugaaugaugccguucuggcacuaacagauuugggucugauauacacagcuaaguauccaaauaguucugaccuagacagacuuucucaaagccauccuauacugaauaugguggacacuaagaagagcuccuugaacauuucugguuacaacuucagcuugggagcugcagugaaagcuggagcuuguaugcuugauggggggaacauguuggagaccaucaagguuacaccucagacaauggauggcaucuugaagucuauuuuaaaggugaaaaaauccuuaggaauguuugucucagacacaccuggugagaggaauccuuaugagaacauacuuuacaagaucugucuuuccggugacggcuggcccuacauagcuucaaggaccuccauuguggguagagcuugggagaauaccaccguggaucucgagucagauggaaagccacaaaaaguggguacagcuggguccaacaagucuuuacagucagcaggauucccaacagggcugaccuauucucaguugaugacacuuaaagacucaaugaugcagcuugacccaagugccaaaaccuggauagacauugaaggucguccagaagacccuguggaaauagcucuuuaccaaccuaugucgggcuguuacauacacuucuucagagaaccaacagacuuaaaacaguucaagcaagaugccaaauauucucaugggauugauguagcagaucuuuucccugcucaaccugguuugacuagugcagucaucgaagcccucccucgcaauaugguacugaccugucaagguucagaugauaucaagagacucuuagacucccaaggaagaagagacauaaagcuuauugacaucucacugagcaaggcugacucuaggagauuugaaaaugcuguuugggaucaaugcaaagaucuaugccauaugcauacuggagugguuguugaaaagaagaaaagaggaggcaaagaagaaauuaccccacacugugcuuuaauggacugcauaauguaugaugcagcugugucaggaggacucaauauaccagucuuaagagcaguucucccuagagacaugguguuuagaacaucaagccccaaggucguccuguaa

SEQ ID NO: 668 - RNA, 1710 nt, Artificial Sequence
  derived and/or modified CDS sequence (wt) from Lassa virus__AIT17471__NP
augagugcuuccaaggaagugaagucauuccuuuggacacagucauugaggagggagcucucaggcuacugcuccagcauaaagcuucaaguugucaaggacgcucaggcucuccuucauggucuugacuuuucugaagucagcaaugugcagcgcuuaaugcgcaaacaaaaaagagacgauagcgaucugaaacgucucagagaucugaaucaggcugucaacaaucuuguugaacuuaaaucaacacagcaaaagagcaucuugagaguugggacuuugacuucagaugaccugcugacacuggcagcugaccuagagaaacuaaagucgaaggucaucagaacagaaaggccacuaaguucagguguuuauauggggaauuugaguacacagcaacuugagcaaagaagagcacugcugaacaugauaggcaugguugguggggcccagggcacccaaccuggaagagacggaguuguuagggugugggaugucaagaauccagaucuuuugaacaaccaguuuggcaccaugcccagccuuacauuggcaugucuuaccaaacaaggucaaguugauuugaaugaugccgucuuggcacuaacagacuuaggucuaauauacacagccaaguauccaaacagcucugaccuggacagacucucccaaagucauccuauacugaacaugguggauacuaagaagagcucccugaacauuucugguuacaacuucaguuugggggcugcagugaaggcuggagcuuguaugcuugauggggggaacauguuggagaccauuaagguuacaccucagacaauggauggcaucuugaagucuauuuuaaaggugaaaagaucuuugggaauguuuguuucagauacaccuggugagaggaacccuuaugagaacauacuuuauaagaucugucuuucuggugacggcuggcccuacauagcuucaaggaccucuauuguagguagagcuugggaaaauacuacuguggaucucgagucagauggcaaaccacaaaaaauggguacuacuggauccaacaaaucccuacagucagcaggguuuccaacaggauugaccuauucucaguugaugacacuuaaggacucaaugaugcagcuugacccaagcgcuaaaaccuggauagacauugaaggucguccagaggacccuguagaaauagcucuuuaccaaccuaugucgggcuguuacauacacuucuucagagaaccaacagaccugaaacaauucaagcaagaugcuaaauauucucaugggauugauguagcagaucuuuucccugcucaaccuggcuugaccagugcaguuauugaagcccucccucgcaauauggugcugaccugucaagggucagaugacauuaagaaacucuuggauucucaagggagaagagacauaaagcuuaucgacauugcacuaagcaaagcugacuccaggaaauuugaaaauguuguuugggaucaaugcaaagaucuaugccacaugcauacuggaguaguugucgaaaagaagaaaagaggaggcaaagaagaaaucacaccacauugcgcucuaauggacugcauuauguaugaugcagcugugucaggaggacucaauauaccaguuuuaagagcaguucucccuagagacaugguguucagaaccucaagccccaaggucguccuguaa

SEQ ID NO: 669 - RNA, 1710 nt, Artificial Sequence
  derived and/or modified CDS sequence (wt) from Lassa virus__AIT17475__NP
augagugcuucuaaggaaguaaagucauuucucuggacacagucauugaggagggagcuuucagguuauugcuccaguauaaagcuucaaguugucaaggaugcucaggcucuccuucauggucuugacuuuucugaagucagcaaugugcagcgcuuaaugcgcaaacaaaagagagacgauagugaucugaaacgucucagggaucugaaucaggcugucaacaaucuuguagaacucaaaucaacacaacaaaagaguguuuugagaguugggaccuugaccucagaugaccugcugacauuggcagccgacuuagagaaacuaaagucgaaggucauaaggacagaaaggccacuuagcucagguguuuauauggggaauuugagugcacagcagcuugagcaaagaagagcauuacugagcaugauaggcaugguugguggggcucagggcacccaaccuggaagagauggaguuguuagggugugggauguuaaaaauccggaucuuuugaacaaccaguucggcaccaugccuagucugacauuagcaugucucaccaaacaaggucaaguugauuugaaugauacuguccuagcacugacagaucugggucuaauauacacagcuaaguacccaaauagcuccgaucuagacagacuuucccaaagccacccuauacugaauaugguggacaccaagaagagcuccuugaacauuucugguuacaacuucagcuuaggagcugcagugaaagcuggagcuuguaugcuugauggggggaauauguuggagaccauuaagguaacaccucagacaauggauggcaucuugaagucaauuuuaaagguuaaaagauccuuaggaauguuuguuucagauacacccggugaaaggaacccuuaugagaauauacuuuacaagaucugccuuucuggugacggcuggcccuauauagcuucaaggacuucuauuguggguagagcuugggagaauacuacuguggaucucgagucagaugggaaaccacaaaaagugggcacugcuggguccaacaagucuuugcagucagcgggauuuccaacagggcugaccuauucucaguugaugacacuuaaagacucaaugaugcagcuugacccaagugccaaaaccuggauagacauugaaggucguccagaagacccuguggaaauagcucuuuaccaaccuauaucgggcuguuacauacacuucuucagagaaccaacagacuuaaaacaguucaagcaggaugccaaauacucucacgggauugauguaacagaucuuuucccugcucaaccugguuugaccagugcagucauugaagcucucccucgcaauaugguacugaccugucaagguucagaugauauuaagagacucuuggacucccaaggaaggagggacauaaagaucauugacauugcacugagcaaggcugacuccaggagauuugaaaaugcuguuugggaucagugcaaagaucuaugccauaugcauacuggagugguugucgaaaagaagaaaagaggaggcaaagaagaaaucaccccgcacugugcuuuaauggacugcauaauguaugaugcagcugugucaggaggacucaauauaccaguuuuaagagcaguucuccccagagacaugguauuuagaaccucaagccccaaagucguccuguaa

SEQ ID NO: 670 - RNA, 1710 nt, Artificial Sequence
  derived and/or modified CDS sequence (wt) from Lassa virus__AIT17479__NP
augagugcuucuaaggaagugaagucauuucucuggacacagucauugaggagggagcuuucagguuauugcuccaauauaaaacuacaaguuguuaaggaugcucaggcucuccuucauggucuugauuuuucugaagucagcaaugugcagcgcuuaaugcgcaaacaaaaaagggaugauagugacuugaaacgucucagagauuugaaucaggcugucaacaaucuuguagaacucaaaucgacacaacaaaagagugucuugagaguugggacccugaccucagaugaccugcugacauuggcagcugacuuagagaaacuaaagucgaaggucauuagaacagaaaggccacuaagcucagguguuuauauggggaauuugaguacacagcagcuugagcagagaagggcauugcugaacaugauagguaugguugguggggcucagggcacccaaccuggaagagacggagucguuagggugugggauguuaagaauccggaccuuuugaacaaccaguucggcaccaugccuagucugacauuagcaugucucacuaaacaaggucaaguugauuugaaugaugccgucuuagcacugacagaccugggccugauauacacagcuaaguacccgaauagcuccgaccuggacagacuuucccaaagccacccuauacugaauaugguggacacuaagaagagcuccuugaacauuucugguuacaacuucagcuuaggggcugcagugaaagccggagcuuguaugcuugauggggggaacauguuggagaccaucaagguuacaccucagacaauggauggcaucuugaagucuauuuuaaaaguaaaaagaucuuugggaauguuuguuucagauacaccuggugagaggaacccuuaugagaauauacuuuacaagaucugucucuccggugacggcuggcccuacauagcuucaaggacuucuauugugggaagagcuugggagaauaccacuguggaucucgagucagauggaaaaccgcaaaaagugggcacugcuggguccaacaagucuuuacagucagcaggguuuccaacagggcugaccuauucucaauuaaugacacucaaagacucaaugaugcagcuugacccaagcgccaaaaccuggauagacaucgaaggucguccagaagacccuguggaaauagcucuuuaccaaccuaugucaggcuguuacauacacuucuucagagaaccaacagacuuaaaacaguucaagcaggaugccaaauauucucaugggauugauguggcagaucucuucccugcucagccugguuugaccagcgcagucauugaagcccucccucgcaauaugguacugaccugucaagguucagaugauaucaagaaacucuuggacucccaaggaagaaaggacauaaagcuuauugacauugcacugagcaagguugacucuaggagauuugaaaaugcuguuugggaucagugcaaagaucuaugccauaugcauacuggagugguugucgaaaagaagaaaagaggaggcaaagaggaaaucaccccgcacugugcucuaauggauugcauaauguaugaugcagcugugucaggaggacucaauauaccaguuuugagagcaguucuccccagggacaugguguuuagaaccucaagccccaaggucguccuguaa

SEQ ID NO: 671 - RNA, 1710 nt, Artificial Sequence
  derived and/or modified CDS sequence (wt) from Lassa virus__AIT17491__NP
augagugcuucuaaggaagugaagucauuucucuggacacagucauugaggagggagcuuucagguuauugcuccaacauaaagcuucaaguuguuaaggaugcucaggcucuccuucauggucuugacuuuucugaaguuagcaaugugcagcgcuugaugcgcaaacaaaagagggaugauggugaucugaaacgucucagagaucugaaucaggcugucaacaaucuuguugaacucaaaucaacacaacaaaagagcgucuugagaguugggaccuugaccucagaugaccugcugacauuggcagcugacuuagagaaacuaaagucgaaggucaucagaacagaaaggccacuaagcucagguguuuauauggggaauuugaguacacagcaacuugagcaaagaagagcauugcuaagcaugauaggcaugguugguggggcucggggcacccagccuggaagagacggaguuguuaggguaugggauguuaagaauccagaucuuuugaacaaccaguucggcaccaugcccagucugacauuagcaugucucacuaaacagggucagguugauuugaaugaugucgucuuagcacuaacagaccugggucuaauauacacagcuaaguauccuaauagcuccgaccuggacagacuuucccaaagccauccuauauugaauaugguggacacuaagaagagcuccuugaauaucucugguuacaacuuuagcuuaggagcugcagugaaagcuggagcuuguaugcuugauggggggaacauguuggagaccaucaagguuacaccucagacaauggauggcaucuugaagucuauuuuaaagguaaaaaaauccuugggaauguuuguuucagauacaccuggugagaggaacccuuaugagaacauacuuuacaagaucugucuuucuggugacggcuggcccuacaucgcuucaaggacuucuauuguggguagagcuugggaaaauacuacuguagaucucgagucagauggaaaaccacagaaagugggagcugcuggguccaacaagucuuuacagucagcgggguuuccaacagggcugacuuauucucaguugaugacacuuaaagacucaaugaugcagcuugacccaagugccaaaaccuggauagacauugaaggucguccagaagacccuguggagauagcucuuuaccagccuaugucgggcugcuauauacacuucuucagagaaccaacagacuuaaaacaguucaagcaagaugccaaauacucucaugggauugauguaacagaucuuuucucugcucaaccuggauuaaccagugcagucauugaagcucucccucgcaauauggugcugaccugucaagguucagaugauauuaagcgacucuuggauucccaaggaagaagggacauaaagcuuauugauauugcacugagcaaggcugacucuaggagauuugaaaaugcuguuugggaucagugcaaagaucuaugccauaugcacacuggaguggucguugaaaagaagaaaagaggaggcaaagaagaaauuaccccacacugugcucuaauggacugcauaauguaugaugcagcugugucaggaggucucaauauaccagucuuaagagcaguccuccccagggacaugguguuuagaaccucaagccccaaggucguccuguaa

SEQ ID NO: 672 - RNA, 1710 nt, Artificial Sequence
  derived and/or modified CDS sequence (wt) from Lassa virus__AIT17495__NP
augagugcuuccaaggaaguaaagucguuccucuggacacagucauugaggagggagcucucagguuacugcuccaacauaaagcuucaaguuguuaaggaugcucaggcucuccuucauggucuugacuuuucugaagucaguaauguucagcgcuugaugcgcaaacaaaaaagggacgacagugaucuaaaacgucucagagaucugaaccaggcugucaacaaucuuguagaacucaaaucaacacaacagaagaguauccugagaguugggaccuugaccucagaugaccugcugacauuggcagcugacuuagagaaacuuaagucgaaggucaucagaacagaaaggccauuaagcucagguguuuacaugggaaaccugaguacacagcaacuugagcaaagaagagcauuacugaacaugauaggcaugguugguggggcucagagugcccaaccuggaagggacggaguuguuagggugugggaugucaagaauccggaucuuuugaacaaucaauucggcaccaugccuagucugacauuagcaugucucaccaaacaaggucaaguugauuuaaaugaugccgucuuagcacuaacagaccugggucuaauauacacagcuaaguacccaaacagcuccgaccuggacagacuuucccaaagccauccuauacugaauaugguggacacuaagaagagcuccuugaauauuucugguuucaacuucaguuuaggagcugcagugaaagcuggagccuguaugcuugauggggggaacauguuggagaccaucaagguuacaccucagacaauggauggcaucuugaaaucuaucuuaaagguaaaaagaucuuuggggauguuuguuucagaugcaccuggugagaggaacccuuaugagaacauacuuuacaagaucugucuuucuggggaugguuggcccuacauagcuucaagaacuuccauuguggguagagcuugggagaacaccacuguggaucucgagucagacggaaaaccacagaaggugggcacugcuggguccaacaaguccuuacagucagcaggguuuccaacagggcugaccuauucccaguugaugacacuuaaagacucaaugaugcaacuugacccaagugcuaaaaccuggauagacauugaaggucguccagaagacccuguggaaauagcucuuuaccaaccuaugucgggcuguuacauacacuucuucagagaaccaacagacuugaagcaguucaagcaagaugccaaauauucucaugggauugauguagcagaucuuuucccugcucaaccuggcuugaccagugcagucauugaagcccuuccucgcaauaugguacugaccugucaggguucagacgauauuaagaaacucuuagauucccaaggaagaagagacauaaagcuuauugacauugcacugagcaaggcugacucuaggagguuugagaaugcuguuugggaucagugcaaggaucuaugccauaugcacacuggggugguuguugaaaagaagaaaagaggaggcaaagaagaaauuaccccacacugugcucuaauggauugcauaauguaugaugcagcugugucaggaggacucaauauaccaguuuugagagcaguucuccccagagacaugguguuuagaacaucaagccccaaggucguccuguaa

SEQ ID NO: 673 - RNA, 1710 nt, Artificial Sequence
  derived and/or modified CDS sequence (wt) from Lassa virus__AIT17499__NP
augagugcuuccaaggaagugaagucauuccucuggacacagucauugaggagggagcuuucagguuauugcuccagcauaaaacuucaaguuguuaaggaugcucaggcucuccuucauggucuugacuuuucugaagucagcaaugugcaacgcuuaaugcgcaaacaaaaaagggaugauagugaucugaaacgucuuagagauuugaaucaggcugucaacaaucuuguagaacucaaaucgacacaacaaaagagcaucuugagaguugggaccuugaccucagaugaccuguugacguuggcagcugacuuagagaaacuaaagucgaaggucauuagaacagaaaggccacuaagcucagguguuuauauggggaauuugaguacacagcagcuugagcaaagaagagcauugcugaacauaauaggcaugguugguggggcucagggcacccaaccuggaagagacggaguuguaagggugugggauguuaagaacccggaucuucugaacaaccaguucggcaccaugccuagucugacauuagcaugucucacuaaacaaggucaaguugauuugaaugaugccgucuuagcacugacagacuugggucuaauauacacagcuaaguauccaaauagcuccgaccuggacagacuuucccaaagccauccuauacugaauaugguggacaccaagaagagcuccuugaacauuucugguuauaacuucaguuuaggagcugcagugaaagcuggagcuugcaugcuugauggggggaacauguuggagaccaucaagguuacaccucagacaauggauggcaucuugaagucuauuuuaaagguaaaaagaucuuuggggauguuuguuucagauacaccuggugagaggaacccuuacgagaacauacuuuauaagaucugucuuuccggugacggcuggccuuacauagcuucaaggacuucuauuguggguagagcuugggagaauaccacuguggaucucgagucagauggaaaaccacaaaaagugggugcugcuggguccaacaagucuuuacagucagcgggguuuccgacagggcugaccuauucucaguugaugacacuaaaagacucaaugaugcaacuugacccaagugcuaaaacauggauagacauugaaggucguccagaagacccuguggaaauagcucuuuaccaaccuaugucgggcuguuacauacacuucuucagagaaccaacagauuuaaaacaguucaagcaagaugccaaauauucucacgggauugauguggcagaucuuuucccugcucaaccugguuugaccagugcagucauugaagcccuuccccgcaauaugguacugaccugucaagguucagaugauguuaagagacucuuggacucucagggaaggagggacauaaagcuuauugacauugcacugagcaaggcugacucuaggagauuugaaaaugcuguuugggaucagugcaaggaucugugccauaugcauacuggagugguugucgaaaagaagaaaagaggagguaaagaagaaauuaccccgcacugugcuuuaauggacugcauaauguaugaugcagcugugucagggggacucaauauaccaguuuuaagagcaguucuccccagagacaugguguuuagaaccucaagccccaaggucguccuguaa

SEQ ID NO: 674 - RNA, 1710 nt, Artificial Sequence
  derived and/or modified CDS sequence (wt) from Lassa virus__AIT17503__NP
augagcucuucuaaggaagugaagucauuucucuggacacaaucauugaggagggagcuuucagguuauugcuccagcauaaagcuucagguugucaaagaugcucaggcucuccuucauggucuugacuuuucugaagucagcaaugugcagcgcuugaugcguaaacagaaaagggaugauagugaucugaaacgucucagagaucugaaucaggcugucaacaaucuuguagaacucaaaucaacacaacaaaagagcauccugagaguugggaccuugaccucagaugaccugcugacauuggcagccgacuuggagaaacuaaagucgaagguuauuagaacagagaggccacuaagcucagguguuuauauggggaacuugagugcgcagcagcuugagcaaagaagagcauuacugaacaugauaggcaugguuggcggugcucagggcacccaaccuggaagagacggaguuguuagagugugggauguuaagaauccggaucuuuugaacaaccaguucggcaccaugccuagucugacauuagcaugucucaccaaacaaggucaaguugauuugaaugaugccgucuuagcacuaacagaccuggguuuaauauacacagcuaaguacccaaauagcucugaccuggauagacuuucccaaagccauccuauacugaauaugguggacacuaagaagagcucuuugaacauuucugguuacaacuucagcuugggagcugcaguuaaggcuggagcuuguaugcuugauggggggaacauguuggagaccaucaagguuacaccucagacaauggauggcaucuugaagucuauuuuaaagguaaaaaaauccuugggaauguuuguuucagauacaccuggugagaggaacccuuaugagaauauacuuuacaagaucugucuuuccggugacggcuggcccuacauagcuucaagaaccucuauuguggguagagcuugggaaaauacuaccguagaucucgagucagaugggaaaccacaaaaagugggcacugcuggguccaacaagucuuuacagucagcgggguuuccaacagggcugaccuauucucaguugaugacacuuaaagacucgaugaugcagcuugauccaagugccaaaaccuggauagacaucgaaggucguccagaagacccuguagaaauagcucuuuaccaaccuaugucgggcuguuacauacacuucuucagagagccaacagacuuaaaacaguucaagcaagaugccaaauauucucaugggauugauguagcagaucuuuucccugcucaaccugguuuaaccagugcaguuauugaagcccucccucgcaacaugguacuaaccugucaagguucagaugauauuaagagacuccuggacucccaagggagaagggacauaaagcucauugacauugcacugagcaaggcugacucuaggagauucgaaaaugcuguuugggaucagugcaaagaucuaugccauaugcauacuggaguuguugucgaaaagaagaaaagaggaggcaaagaagagauuaccccgcacugugcuuuaauggacugcauaauguaugaugcagcugugucaggaggacucaauauaccaguuuuaagggcaguucuccccagagacaugguguuuagaaccucaagccccaaagucguccuguaa

SEQ ID NO: 675 - RNA, 1710 nt, Artificial Sequence
  derived and/or modified CDS sequence (wt) from Lassa virus__AIT17507__NP
augagugcuucuaaggaagugaagucauuucucuggacacagucuuugaggagggagcuuucagguuauugcuccaauauaaaacuucaaguuguuaaggaugcucaggcccuccuucauggucuugacuuuuccgaagucagcaaugugcagcgcuuaaugcgcaaacaaaagagggaugauagugaucuaaaacgucucagagauuugaaucaggcugucaacaaucuuguagaacuuaaaucgacacaacaaaagaguaucuugagaguugggaccuugaccucagaugaccugcugacauuggcagcugacuuagagaaacuaaagucgaaggucauuagaacagaaaggccacuaagcucagguguuuauauggggaauuugaguacacagcagcuugagcagagaagagcauugcugaacuugauaggcaugguugguggggcucagggcacccaaccuggaagagacggaguuguuaggguuugggauguuaagaauccagaccuuuugaacaaccaguucggcaccaugccuagucugacauuggcaugucucaccaaacaaggucaaguugauuugaaugaugcugucuuagcacugacagaccugggccuaauauacacagccaaguacccaaauagcuccgaccuggacagacuuucccaaagccauccuauauugaauaugguggacacuaagaagagcuccuugaacauuucugguuucaacuucagcuuaggagcugcagugaaagcuggagcuuguaugcuugauggggggaacauguuggagaccaucaagguuacaccucagacaauagauggcaucuugaagucuauuuuaaagguaaaaaaaucuuugggaauguuuguuucggacacaccuggugagaggaacccuuaugagaauauacuuuacaagaucugucuuuccggugacggauggcccuacauagcuucaaggacuuccauuguggguagagcuugggagaauaccacuguggaucucgagucagauggaaaaccgcauaaaguggguacugcuggguccaacaagucuuuacagucagcgggguucccaacagggcugacuuauucucaauugaugacacuuaaagacucaaugaugcagcuugacccaagugccaaaaccuggauagacauugaaggucguccagaagacccuguggagauagcccuuuaccaaccuaugucaggcuguuacauacacuucuucagagaaccaacagacuugaaacaguucaagcaagaugccaaguauucucaugggauugauguggcagaucuuuucccugcucaaccugguuugaccagcgcagucauugaagcccucccucgcaauauggugcuaaccugucaagguucagaugauauuaagagacucuuagacucccaaggaagaagggauauaaagcuuauugacauugcacugagcaagguugacucuaggagauuugaaaaugcuguuugggaucagugcaaagaucuaugccauaugcacacuggaguaguugucgagaagaagaaaagaggaggcaaagaagagaucaccccgcacugugcuuugauggacugcauaauguaugaugcagcugugucaggaggacucaauauaccaguuuuaagggcaguucuccccagggacaugguguuuagaaccucaagucccaaggucguccuguaa

SEQ ID NO: 676 - RNA, 1710 nt, Artificial Sequence
  derived and/or modified CDS sequence (wt) from Lassa virus__AIT17511__NP
augagugcuucuaaggaagugaagucauuucucuggacacagucauugaggagggagcuuucagguuauugcuccaacauaaagcuucaaguuguuaaggaugcucaggcucuccuucauggucuugacuuuucugaaguuagcaaugugcagcgcuugaugcgcaaacaaaagagggaugauggugaucugaaacgucucagagaucugaaucaggcugucaacaaucuuguagaacucaaaucaacacaacaaaagaguaucuugagaguugggacuuugaccucagaugaccugcugacauuggcagcugacuuagagaaacuaaagucgaaggucaucagaacagaaaggccacuaagcucagguguuuauauggggaaucugaguacacagcaacuugagcaaagaagggcauugcugaacaugauaggcaugguugguggggcucagggcacccaaccuggaagagacggaguuguuagggugugggauguuaagaauccagaucuuuugaacaaccaauucggcaccaugcccaguuugacauuagcaugucucacuaaacagggucagguugauuugaaugaugcugucuuagcacuaacagaccugggucuaauauacacagcuaaguauccuaauagcucugaccuggacagacuuucccaaagccauccuauauugaauaugguggacacuaagaagagcucuuugaacaucucugguuacaacuuuaguuuaggagcugcagugaaagcuggagcuuguaugcuugauggggggaacauguuggaaaccaucaagguuacaccucagacaauagauggcaucuuaaagucuauuuugaagguaaaaaaauccuugggaauguuuguuucagauacaccuggugaaaggaacccuuaugagaacauacuuuacaagaucugucuuuccggugacggcuggccuuacaucgcuucaaggacuucuauuguggguagagcuugggagaauacuacuguagaucuugagucagauggaaaaccacaaaaagugggaacugcuggauccaacaagucuuuacagucagcgggguuuccaacagggcugacuuauucucaguugaugacacuuaaagacucaaugaugcaacuugacccaagugccaaaaccuggauagacauugaaggucguccagaagacccuguggagauagcucuuuaccagccuaugucgggcugcuauauacacuucuucagagaaccaacagacuuaaaacaguucaagcaagaugccaaauauucucaugggauugauguaacagaucuuuucucugcucaaccuggauuaaccagugcagucauugaagcucucccucgcaauaugguacugaccugucaagggucagaugauauuaagcgacucuuggauucccaaggaagaagggacauaaagcuuauugacauugcacugagcaaggcugacucuaggagauuugaaaaugcuguuugggaucagugcaaagaucuaugccauaugcacacuggaguggucgucgaaaagaagaaaagaggaggcaaagaagaaauuaccccacacugugcucuaauggacugcauaauguaugaugcagcugugucaggaggucucaauauaccaguucugagggcaguccuccccagggacaugguguuuagaaccucaagccccaaggucguccuguaa

SEQ ID NO: 677 - RNA, 1710 nt, Artificial Sequence
  derived and/or modified CDS sequence (wt) from Lassa virus__AIT17515__NP
augagugcuuccaaggaagugaagucauuucucuggacacagucauugaggagggagcuuucagguuauugcucuagcauaaaacuucaaguuguuaaggaugcucaggcucuccuucauggucuugacuuuucugaagucagcaaugugcagcgcuuaaugcgcaaacaaaagagggaugauagugaucugaaacgucuuagagauuugaaucaggcugucaacaaucuuguagaacucaaaucgacacaacagaagagcaucuuaagaguugggacuuugaccucagaugaccugcuaacauuagcagcugacuuagagaaacuaaagucgaaggucauuagaacagaaaggccacuaagcucaggugucuauauggggaauuugaguacacagcagcuugagcagagaagagcauugcugaacaugauaggcaugguugguggggcucagggcacccaaccuggaagagacggaguuguuagggugugggauguuaagaauccggaucuuuugaacaaccaguucggcacuaugccuagucugacauuggcaugucucaccaaacaaggucaaguugauuuaaaugaugccgucuuagcacuaacagaccugggucuaauauacacagcuaaguauccaaauagcuccgaccuggauagacuuucccaaagccauccuauacugaauaugguggauacuaagaagagcuccuugaauauuucugguuacaacuucaguuugggagcugcggugaaagccggagcuuguaugcuugauggggggaacauguuggagaccaucaagguuacaccucagacaauggauggcaucuugaagucuauucuaaaggugaaaagauccuugggaauguuuguuucagauacaccuggugagaggaaccccuaugagaacauacuuuacaagaucugucuuuccggugacggcuggcccuacauagcuucaaggacuucuauuguggguagagcuugggagaauacuacuguggaucucgagucagauggaaaaccacaaaaagugggugcugcuggguccagcaaaucuuuacagucagcgggguuuccaacaggguugaccuauucucaguugaugacacuuaaagacucaaugaugcagcuugacccaagugccaaaaccuggauagacauugaaggucguccagaagauccuguggaaauagcucuuuaccaaccugugucgggcuguuauauacacuucuucagagagccaacagauuuaaaacaguucaagcaagaugccaaguauucucacgggauugauguggcagaucuuuucccugcucaaccugguuuaaccagugcaguuauugaggcccucccucgcaauauggugcugaccugucaagguucagaugauauuaagagacucuuagacucccaaggaagaagggacauaaagcuuauugacauugcacugagcaaggcugacuccaggagauuugagaaugcuguuugggaucagugcaaagaucuaugccauaugcauacuggagugguugucgaaaagaagaagagagggggcaaagaagaaauuaccccgcacugugcuuuaauggacugcauaauguaugaugcagcugugucaggaggacucaauauaccaguuuuaagagcaguucucccuagagauaugguguuuagaaccucaagccccaaggucguccuguaa

SEQ ID NO: 678 - RNA, 1710 nt, Artificial Sequence
  derived and/or modified CDS sequence (wt) from Lassa virus__AIT17519__NP
augagugcuucuaaggaagugaagucauuucucuggacacagucauugaggagggagcucucagguuauugcuccaacauaaaacuucaaguugucaaagaugcucaagcucuccuucauggucuugacuuuucugaagucagcaaugugcagcgcuuaaugcgcaaacagaagagggaugauagugaucugaaacgucucagagauuugaaucaggccgucaacaaucuuguagaacucaaaucgacacaacaaaagagcaucuugagaguugggaccuugaccucagaugaccuacugacacuggcagcugacuuagagaaacuaaagucgaaggugauuaggacagaaaggccacuaagcucagguguuuacauggggaauuugagugcacagcagcuugagcaaagaagagcacugcugaacaugauaggcauggucgguggggcucagggcacccaaccuggaagagauggaguuguuagggugugggauguuaagaauccggaucuuuugaacaaucaguucggcaccaugcccagucugacauuagcaugccuuacuaaacaaggucaaguugauuugaaugaugcuguccuagcacuaacagaccugggucuaauauacacagccaaguauccaaacagcuccgaccuagacaggcuuucccaaagccauccuauacugaauaugguggacacuaagaagagcuccuugaauauuucugguuucaacuucagcuuaggagcugcagugaaagcuggagcuugcaugcuugauggggggaacauguuggagaccauuaagguuacaccucagacaauggauggcaucuuaaagucuauuuuaaaggugaaaagaucuuugggaauguuuguuucagauacaccuggugagaggaacccuuacgagaacauacuuuacaagaucugucuuuccggugacggcuggcccuacauagcuucaaggacuuccauuguggguagagcuugggagaauacuacuguggaucucgagucagauggaaaaccacagaaaguggguacugcuggguccaauaagucuuuacagucagcaggguuuccaacagggcugaccuauucucaguugaugacacuuaaagacucaaugaugcagcuugacccaagugccaaaaccuggauagacauugaaggucgaccagaagacccuguggaaauagcucuuuaccaaccuaugucggguuguuacauacacuucuucagagagccaacagauuuaaaacaguucaagcaagaugccaaauauucucacgggauugauguggcagaucuuuucccugcucaaccugguuugacuagugcagucauugaagcccucccucgcaauaugguacugaccugccaagguucagaugacaucaaaagacuccuggacucccaaggaagaagggacauaaagcuuauugacauugcacugagcaaggcugacucuaggagauuugaaaacgcuguuugggaucagugcaaagauuuaugccauaugcauacuggugugguugucgaaaagaagaaaaggggaggcaaagaagaaauuaccccgcacugugcuuuaauggacugcauaauguaugaugcagcugugucaggaggacucaauauaccaguuuuaagagcaguucuccccagagacaugguguuuagaaccucaagccccaaggucguccuguaa

SEQ ID NO: 679 - RNA, 1710 nt, Artificial Sequence
  derived and/or modified CDS sequence (wt) from Lassa virus__AIT17525__NP
augagugcuucuaaggaaguaaagucauuucucuggacacagucauugaggagggagcuuucagguuauugcuccagcauaaaacuucagguuguuaaggaugcucaggcucuccuucauggucuugacuuuucugaagucagcaaugugcagcgcuuaaugcgcaaacaaaggagggaugauagugaucugaaacgucucagagauuugaaucaggcugucaacaaucuuguagaacucaaaucgacacaacaaaagagcaucuugagaguugggaccuugaccucggaugaccugcugacauuggcagccgaucuagaaaaacuaaagucgaaggucauuagaacagaaaggccacuaaguucagguguuuauauggggaauuugagcacgcagcagcuugagcaaagaagagcacugcugaacaugauaggcaugguugguggggcccagggcacccaaccuggaagggacggaguuguuagagugugggauguuaagaauccggaucuuuugaacaaucaguucggcaccaugccuagucugacauuagcaugucucaccaaacaaggccaaguugauuugaaugaugcugucuuagcacuaacagaucugggucuaauauacacagcuaaguauccaaauagcuccgaccuggacagacuuucccaaagccauccuauacugaacaugguggacaccaagaagagcuccuugaacauuucuggcuacaacuucagcuuaggagcugcagugaaagcuggagcuuguaugcuugaugggggaaacauguuggagaccauuaaggucacaccucagacaguggauggcaucuugaagucuauuuuaaagguaaaaagaucuuugggaauguuuguuucagauacaccuggugagaggaacccuuacgagaacauacuuuacaagaucugucuuucuggcgacggcuggcccuacauagcuucaaggaccucuauuguggguagagcuugggagaauacuacuguggaucucgagucagauggaaaaccacagaaaguggguacugcuggguccaacaagucuuuacagucagcgggguuuccaacagggcugaccuauucucaguugaugacacuuaaagacucgaugaugcagcuugacccaagugccaaaaccuggauagacauugagggucguccagaagacccuguggaaauugcucuuuaccaaccuaugucuggcuguuacauacacuucuucagagaaccaacagauuuaaaacaguucaagcaagaugccaaauauucucaugggauugauguggcagaucuuuucccuacucaaccugguuugaccagugcagucauugaagcucucccucgcaacaugguacugaccugucaagguucagaugauauuaagagacucuuggacucccaaggaagaagggacauaaagcuuauugacauugcacugagcaaggcugauuccaggaaauuugaaaaugcuguuugggaucagugcaaagaucuaugccauaugcauacuggagugguugucgaaaagaagaaaagaggagguaaagaagaaaucaccccgcacugugcuuuaauggacugcauaauguaugaugcagcugugucaggaggacucaacauaccaguucuaagagcaguucuccccagagacaugguguuuagaaccucaagccccaaagucguccuguaa

SEQ ID NO: 680 - RNA, 1710 nt, Artificial Sequence
  derived and/or modified CDS sequence (wt) from Lassa virus__AIT17533__NP
augagugcuuccaaagaagugaaaucauuccuuuggacacaaucacugaggagagagcuuucagguuacugcuccaacauaaagcuucaaguugucaaggaugcccaagcccuccuucacggccuugacuucucugaagucaacaauguccaacgccuaaugcgcaaacaaaagagagaugacagcgauuuaaaacgccuuagagaccugaaucaggcagucaacaaccuuguugaacucaaaucaacacaacaaaagagcauccugagaguuggaacacugaccucagaugacuugcugacauuggcagcugacuuagaaaaacugaagucaaaagucaucagaacagagagaccacugaguucggguguauacauggggaacuuaaguacacagcagcucgagcagagaagggcauugcuuaacaugauuggcauggcugguggaacucagggcacccaaccugggagagaugggguuguuagggugugggaugucaaaaauccagaucucuuaaacaaucaauucggcaccaugcccagucugacauuggcaugucucacuaaacaaggucaaguugaccuaaaugaugcuguccuagcacugacggauuugggacugauauacacagcuaaguacccaaacagcucugaccuagacagacuuucccaaagucauccaauacuaaacaugguggacacuaagaagagcucccugaauauuucugguuacaauuuuagcuugggggcugcaguaaaagcuggggccuguaugcuugaugggggcaacauguuggaaaccauuaaaguuacgccucagacaauggauggcaucuugaagucuauuuuaaaggugaaaagaucccugggaauguuugucucagauacaccuggugagaggaacccuuaugagaacauacuuuauaagaucugucuuucuggugauggcuggcccuacauagccucaagaaccucuauugugggcagggcuugggagaacacuacuguggaucuagagucagauggaaaaccacaaaaagugggaacugcuggguccaauaagucuuugcagucugcaggauuuccaacaggguugacuuauucacagcugaugacucuaaaagacucaaugaugcagcuugacccaagugcuaaaaccuggauagacauugaaggucguccagaagacccuguggagauagcucuuuaucaaccuaugucaggcuguuacauacauuucuuuagagaaccaacagauuuaaaacaguucaagcaagacgccaaguauucucaugggauugauguggcagaucuuuucccugcucaaccugguuuaaccagugcagucauugaggcccuuccucgcaacaugguguugacuugccaagguucagaugauaucaagaaacuccuggacucucaaggaagaagggacauaaaacucauugauauuucauuaaguaagauugacucuagaaaguuugaaaaugcuguuugggaccagugcaaagacuugugccauaugcacacuggaguaguuguugagaagaagaaaagaggaggcaaagaagaaaucaccccacauugugcuuugauggauugcauaauguuugaugcagcagugucaggagggcucaacauaccaguucugagagcuguccuucccagagacaugguuuuuagaaccucaagccccaaggucguccuguaa

SEQ ID NO: 681 - RNA, 1710 nt, Artificial Sequence
  derived and/or modified CDS sequence (wt) from Lassa virus__AIT17539__NP
augagugcuuccaaggaagugaaaucauuccuuuggacacagucacuaaggagagagcuuucaggcuauugcucuaauauaaaacuccaggugguuaaggaugcacaggcccuucugcauggccucgauuucucugaggucagcaauguccagcgcuugaugcgcaaacagaaaagagaugacggugaccuaaaacgucuuagagaccuaaaucaggcaguuaacaaucuuguugagcucaagucaacacaacaaaagaguguucuaagaguuggaacacugaccucagacgacuugcugauuuuagcagcugaucuagagaaauugaagucaaaggucauuaggacagagaggccauugaguucugguguguauaugggaaacuugagcacacaacaacuugagcagaggaaggcguuauugaguaugauaggcauggucgguggugcucagggaacccaaccuggaagggacggaguugucagggugugggauguaaaaaacccggaccuccucaacaaccaauuuggcaccaugccuaguuuaacacuagcaugucucacuaaacagggucagguugacuuaaaugacgccguucuggcgcuaacagacuugggguuaauauacacagcuaaauaccccaauaguucugaccuagauagacuuucccagagccaucccauauuaaacaugguagacaccaagaagagcucccuaaauauuucuggcuauaauuuuaguuugggagcugcagugaaggcuggagcuugcaugcucgauggggguaacauguuggaaacuauuaaggugacgccucagacaauggauggcauucugaaguccauucuaaaggugaaaaggucccugggaauguuuguuucagacacaccuggugaaagaaacccuuaugaaaacauacuuuacaaaauuugucucucuggggacggcuggcccuacauagcuucaagaaccuccauuguggguagagcuugggagaauaccacuguggaccuugagucagaugggaaaccacagaaaguggguucugcuggauccaacaaaucucugcaaucugcaggguucccaacagggcuaacuuauucucaacugaugacacucaaagauucaaugaugcaacuugacccaagcgccaaaaccuggauagacaucgagggucguccagaagacccuguugagauagcucuuuaccaaccuaugucaggcuguuauauacauuucuucagagaaccaacagauuuaaaacaguucaaacaagaugccaaauauucucaugggauugaugugacagaucucuuuucugcucagccuggucuaaccagugcagucauugaggcucucccccgcaacaugguguuaacgugucaagguucagacgacauuaaaaaacucuuagauucucaggggagaagggacaucaagcucaucgauaucucauuagguaaggcugauucuaggagauuugaaaaugcugucugggaccagugcaaagauuugugucacaugcacaccggaguggucguugagaaaaagaagagaggaggcaaagaggagaucacuccacacugugcuuuaauggauugcauaauguuugacgcagcugugucaggaggacuuaauauaccaaucuugagggcuguucucccaagagacaugguguucagaacuucaagucccaaagucguccuguaa

SEQ ID NO: 682 - RNA, 1710 nt, Artificial Sequence
  derived and/or modified CDS sequence (wt) from Lassa virus__AIT17541__NP
augagugcuucgaaagaagugaagucauuccuguggacucagucccugaggagagagcuauccggcuauugcuccaacauaaagcugcaaguggucaaagaugcucaagcucucuuacacggucuugacuucucugaaguuagcaauguucagcgauuaaugcgcaagcagaagagagaugacggugaucuaaaacgccuuagagaucugaaucaggcaguuaauaaccuuguugagcuuaaaucuacacaacaaaaaaguguucucagaguugggacucucagcucugaugacuuacugacuuuggcugcugauuuagagaaguugaagucuaaagucauccguacugagagaccauuaagcucaggagucuauauggggaaucugagcucccagcagcuugaucagagaagggcucuguugaacaugauugguaugacuagugauagacaaggggcaagcaccgggagagauggcauagugagaguuugggaugucaagaaugcagaauuguuaaauaaucaauucgggacggugccaagucugacucuagccugcuugaccaaacaggggcaaguggaucugaaugaugcuguccaagcucugacagauuugggucugauuuauaccgcuaaguaucccaauucaucugauuuagauaggcucucucaaagucacccuaucuuaaacaugauugacaccaaaaagaguucccucaacaucucuggcuacaacuucagucugggugcugcagugaaggcaggagccugcaugcuugauggcggcaauauguuagagacaaucaaaguuucaccccaaacuauggaugggauuuuaaaaucaauucugaaggucaagaggagcuuggggauguuuguaucagacauuccaggugagaggaauccauaugagaacauauuauacaaaaucugccuuucaggagacggauggccuuacauugcaucaagaacuucaaucacugguagggcuugggaaaacacuauaguagauuuggagucagacagcaaaccucagaagcccggaaauaguggguccaacagaucccugcaaucugcaggcuucccugcgggacugaccuauucucagcucaugacucucaaggauuccaugcugcaauuggacccaaacgccaagacuuggauggacauugaagguaggccagaugauccaguugagauagcuuuauaucaaccaagcucaggcuguuacauucauuucuuuagggagccaacugaucucaaacaauucaagcaagaugcaaaguauucacaugggauugaugugggugacuuguuugcugcgcagcccggccugacaagugcaguuauagaggcacucccacgaaacauggucaucaccugucaagggucggaagacauuaagaaacucuuagaaucacaaggaagaaaagauauaaaauugguggacaucucuaugagcaaaccggacuccagaaaguuugagaacgcuguuugggaucaguacaaagacuugugccacaugcauacgggcauugugguugagaaaaagaaaagggguggcaaggaagaaaucacaccacauugugcacuaauggauugcaucauguuugacgcagcuguagugggugggcuugaugccaggaucuuaagagcuguguuacccagggacauggucuucaggaccucaacaccuaaggucguccuguaa

SEQ ID NO: 683 - RNA, 1710 nt, Artificial Sequence
  derived and/or modified CDS sequence (wt) from Lassa virus__AIT17545__NP
augagugcuucuaaggaagugaagucauuucucuggacacagucauugaggagggagcuuucagguuacuguuccaacauaaaacuucaaguuguuaaggaugcucaggcucuccuucauggucuugacuuuucugaagucaguaaugugcagcgcuuaaugcgcaaacaaaaaagggaugauagugaucugaaacgucucagagaucuaaaucaagcugucaacaaucuuguagaacucaaaucgacacaacaaaagagugucuugagaguugggacucugaccucagaugaccugcugacauuggcagcugacuuagagaaacuaaagucgaaggucauuagaacagagagaccacuaagcucagguguuuauauggggaauuugaguacacagcagcuugagcaaagaagagcauugcugaacaugauaggcaugguugguggggcucagggcacccaaccuggaagagacggaguuguuagggugugggauguuaagaauccggaucucuugaacaaccaguucggcaccaugccuagucugacauuagcaugucucaccaaacaaggucaagucgauuugaacgaugcugucuuagcacuaacagaccugggcuuaauauacacagcuaaguacccaaauagcucugaccuggacagacuuucucaaagccaucccauacugaauaugguggacacuaagaaaaguucccugaacauuucugguuacaacuucagcuuaggagcugcagugaaagcuggggcuugcaugcuugauggggggaacauguuggaaaccaucaagguuacaccucaaacaauggauggcaucuugaagucuauuuuaaagguaaaaaaaucuuugggaauguuugucucagacacaccuggugagaggaauccuuaugaaaacauacuuuacaagaucugucuuuccggugauggcuggccuuacauagcuucaaggacuucuauuguggguagggcuugggaaaauacuacuguggaucuugagucagaugggaaaccacaaaaagugggcauugcuggguccaacaagucuuuacagucagcaggguuuccaacagggcuaaccuacucucaguugaugacacucaaagauucaaugaugcagcuugacccaagugccaaaaccuggauagacauugagggucguccagaagacccuguggaaauagcucuuuaucaacccaugucgggcuguuacauacacuucuuuagagaaccaacagacuuaaaacaguucaagcaagaugcuaaauauucucaugggauugauguggcagaucuuuucucugcucaaccugguuugaccagugcagucaucgaagcccuuccucgcaauaugguacugaccugucaagguucagaugauauuaagagacucuuggacucccaaggaagaagggacauaaaacuuauugacauugcacugagcaaggcugacucuagaaaauuugaaaaugcuguuugggaucagugcaaagaucuaugccacaugcauacuggagugguugucgaaaagaagaaaagaggaggcaaagaagaaauuaccccgcacugugcuuuaauggauugcauaauguaugaugcagcuguguccggaggacucgauauaccaguuuuaagagcaguucuccccagggacaugguguuuagaaccucaagccccaaggucguccuguaa

SEQ ID NO: 684 - RNA, 1710 nt, Artificial Sequence
  derived and/or modified CDS sequence (wt) from Lassa virus__AIT17549__NP
augagugcuucuaaggaggugaagucauuucucuggacacagucauugaggagggagcucucagguuauugcuccaacauaaaacuucaaguuguuaaggaugcucaggcucuccuucauggucuugauuuuucugaagucagcaaugugcagcguuuaaugcgcaaacaaaaaagggacgauagugaucugaaacgucucagagauuugaaucaggcugucaacaaucuuguagaacucaaaucgacacaacaaaagagcauccugagaguugggaccuugaccucagaugaccugcugacauuggcagcugacuuagagaaacuaaaaucgaagguuauuagaacagaaaggccacuaagcucagguguuuauauggggaauuugaguacacagcagcuugagcagagaagagcauugcugaacaugauaggcaugguugguggggcccagggcacccaaccugggagagacggaguuguuagggugugggauguuaagaauccggaucucuugaacaaccaguucggcaccaugcccagucugacauuagcaugucucaccaaacaaggucaaguugauuugaaugaugucgucuuagcacuaacagaccugggucuaauauacacagcuaaguacccaaauagcucugaccuggauagacuuucccaaagucauccuauacugaauaugguggacacuaagaaaagcuccuugaacauuucugguuacaacuucagcuugggagcugcagugaaagcuggagcuuguaugcuugauggggggaacauguuggagaccaucaagguuacaccucagacaauggauggcaucuugaagucuauuuuaaagguaaagaaaucuuugggaauguuuguuucagacacaccuggugagaggaacccuuaugagaacauacuuuauaagaucugucuuuccggugacggcuggcccuacauagcuucaaggacuuccauuguggguagagcuugggagaauacuacuguggaucucgagucagauggaaaaccgcaaaaagugggcacuguuggguccaacaagucuuuacagucagcgggguucccaacagggcugaccuauucucaguugaugacacuuaaagacucaaugaugcagcuugacccaagugccaaaaccuggauagacauugaaggucguccagaagacccuguggaaauagcucuuuaccaaccuaugucgggcuguuacauacacuucuucagagaaccaacagacuuaaaacaguucaagcaagaugccaaauauucccaugggauugauguggcggaucuuuucccugcucagccuggcuuaaccagcgcagucauugaagcccucccucgcaauaugguacugaccugucaagguucagaugauauuaagaaacucuuggacucccaaggaagaagggacauaaagcuuauugacauugcacugagcaaagcugacucuaggaaauuugaaaaugcuguuugggaccagugcaaagaccuaugccauaugcauacuggagugguugucgaaaagaagaagagaggaggcaaagaagaaauaaccccgcacugugcuuugauggacugcauaauguaugaugcagcugugucaggaggacucaacauaccaguuuuaagagcaguucuccccagggacaugguguuuagaaccucaagccccaaggucguccuguaa

SEQ ID NO: 685 - RNA, 1710 nt, Artificial Sequence
  derived and/or modified CDS sequence (wt) from Lassa virus__AIT17553__NP
augagugcuuccaaagaagugaagucauuccuuuggacacagucauugaggagggagcucucaggauacugcuccagcauaaagcuucaaguugucaaggacgcucaggcucuccuucauggucuugacuuuucugaagucagcaaugugcagcgcuuaaugcgcaaacaaaaaagagacgauagugaucugaaacgucucagagaucugaaucaggcugucaacaaucuuguugaacuuaaaucaacacaacaaaagagcaucuugagaguugggacuuugacuucagaugacuugcuaacacuagcagcugaccuagagaaacuaaagucgaagguuaucagaacagaaaggccacuaagcucagguguuuauauggggaauuugaguacacagcaacuugagcaaagaagagcacugcugaacaugauaggcaugguugguggggcccagggcacccaaccuggaagagacggaguugucagggugugggaugucaagaauccggaucuuuugaacaaccaguucggcaccaugcccagccuuacauuggcaugucuuaccaaacaaggucaaguugauuuaaaugaugccgucuuggcacuaacagaccugggucuaauauacacagccaaguauccaaacagcucugaccuggacagacuuucccaaagucauccuauacugaacaugguggacacuaagaagagcucccugaacauuucugguuacaacuucagcuugggagcugcagugaaggcuggagcuuguaugcuugauggggggaacauguuggagaccauuaaggucacaccucagacaauggauggcaucuugaagucuauuuuaaaggugaaaagaucuuugggaauguuuguuucagauacaccuggugagaggaacccuuaugagaacauacuuuacaagaucugucuuucuggugacggcuggcccuacauagcuucaaggaccucuauuguagguagagcuugggaaaauacuacuguggaucucgagucagauggcaagccacaaaaaauggguacugcuggauccaacaagucucuacagucagcaggguuuccaacaggguugaccuauucucaguugaugacacucaaagacucaaugaugcagcuugacccaagugccaaaaccuggauagacauugaaggucguccagaagacccuguagagauagcucuuuaccaaccuaugucaggcuguuacauacacuucuucagagaaccaacagaccugaaacaguucaagcaagaugcuaaauauucucaugggauugauguagcagaucuuuuccccgcucaaccuggcuugacuagugcgguuaucgaagcccucccucgcaauauggugcugaccugucaaggcucagaugacauuaagaaacuuuuggauucucaagggagaagagacauaaagcuuaucgauauugcacuaagcaaggcugacuccaggagauuugaaaaugcuguuugggaucaaugcaaagaucuaugccacaugcauacugggguaguugucgaaaagaagaaaagaggggguaaagaagaaaucacaccacauugcgcuuuaauggacugcauuauguaugaugcagcugugucaggaggacucaacauaccaguuuuaagagcgguucucccuagagacaugguguucaggaccucaagccccaaggucguccuguaa

SEQ ID NO: 686 - RNA, 1710 nt, Artificial Sequence
  derived and/or modified CDS sequence (wt) from Lassa virus__AIT17561__NP
augagugcuucuaaggaagugaagucauuucucuggacacagucauugaggagggagcuuucagguuauugcuccaacauaaaacuucaaguuguuaaggaugcucaagcucuccuucauggucuugacuuuucugaagucagcaaugugcaacgcuuaaugcgcaaacaaaaaagggaugacagugaucuaaaacgucucagagauuugaaucaggcugucaacaaucuuguggaacucaaaucgacacaacaaaagaguaucuugagaguuggaaccuugaccucagaugaccugcugacauuggcagcugacuuagagaaacuaaagucgaaggucauuagaacagaaaggccacuaagcucagguguuuauauggggaauuugaguacacagcagcuugagcagagaagagcauugcugaacaugauaggcaugguugguggggcucaaggcacucaaccuggaagagauggaguuguuaggguaugggauguuaagaauccagaucuuuugaacaaucaguucggcaccaugcccagucugacauuagcaugucucaccaaacagggucaaguugauuugaaugaugcugucuuagcacuaacagaccugggucugauauacacagcuaaguauccaaauagcuccgaccuggauagacuuucccaaagccauccuauauugaauaugguggacacuaagaaaagcuccuugaacauuucugguuacaacuucagcuuaggagcugcagugaaagcuggagcuuguaugcuugauggggggaacauguuggagaccaucaagguuacaccucagacaauagauggcaucuugaagucuauuuuaaagguaaaaaaaucuuugggaauguuuguuucagauacaccuggugagaggaacccuuaugagaacauacuuuacaagaucugucucuccggugauggcuggcccuauauagcaucaaggaccucuauuguggguagagcuugggagaacacuacuguggaucucgagucagauggaaaaccgcaaaaggugggcacuguuggguccaacaagucuuuacagucagcgggauucccaacagggcugaccuauucucaguugaugacacuuaaagacucaaugaugcaacuugacccaagugccaaaaccuggauagacauugaaggucguccagaagacccuguggaaauagcucuuuaccagccuaugucggguuguuacauacacuucuucagagaaccaacagacuuaaaacaguucaaacaagaugccaaauauucucaugggauugauguggcagaucuuuucccugcucaaccugguuugaccagcgcagucauugaagcccucccucgcaauaugguacugaccugucaagguucagaugauauuaagagacucuuggacucccaaggaagaagggacauaaagcuuauugacauugcacugagcaaggcugacucuaggagauuugagaaugcuguuugggaucaaugcaaagaucuaugccauaugcauacuggagugguugucgaaaagaagagaagaggaggcaaagaagaaauuaccccgcacugugcuuuaauggacuguauaauguaugaugcagcugugucaggaggacucaauauaccaguuuuaagagcaguucuccccagggacaugguauuuagaaccucaagccccaaggucguccuguaa

SEQ ID NO: 687 - RNA, 1710 nt, Artificial Sequence
  derived and/or modified CDS sequence (wt) from Lassa virus__AIT17565__NP
augagugcuuccaaggaaauaaagucauuccuuuggacacagucuuugaggagggagcucucagguuacugcuccagcauaaaacuucaaguuguuaaggaugcucaggcucuccuucauggucuugacuuuucugaagucagcaauguucagcgcuuaaugcgcaaacaaaaaagggacgacagugaucugaaacgucucagagaucugaaccaggcugucaacaaucuuguagaacucaaaucaacacaacaaaagaguauccugagaguugggaccuugaccucagaugaccugcugacauuggcagcugacuuagagaaacuuaagucgaaggucaucagaacagaaaggccacuaagcucagguguuuauaugggaaauuugaguacacagcaacuugagcaaagaagagcauugcugaacaugauaggcaugguugguggggcucaggguacccaaccuggaagggacggaguuguuagggugugggaugucaagaauccggaucuuuugaacaaccaauuuggcaccaugcccagucugacauuggcgugucucaccaaacaaggucaaguugauuuaaaugaugcuguuuuagcacuaacagaccugggucuaauauacacagcuaaguacccaaacagcuccgaccuggacagacuuucccaaagccauccuauacugaauaugguggacacuaagaaaagcuccuugaauaucucugguuacaacuucaguuuaggagcugcagugaaagcuggagccuguaugcuugauggggggaacauguuggagaccauuaagguuacaccucagacaauggauggcaucuugaaaucuaucuuaaagguaaaaagaucuuugggaauguuuguuucagaugcaccuggugagaggaacccuuaugagaacauacuuuacaagaucugucuuucuggggacgguuggcccuacauagcuucaagaacuuccauuguggguagggcuugggagaacaccacuguggaucucgagucagauggaaaaccacaaaaggugggcacugcuggguccaacaagucuuuacagucagcgggguuuccaacaggguugaccuauucucaguugaugacacuuaaagacucaaugaugcaacuugacccaagugcuaaaaccuggauagacauugaaggucguccagaagacccuguagaaauagcucuuuaccaaccuaugucgggcuguuacauacacuucuucagagaaccaacagacuugaaacaguucaagcaagaugccaaauauucucaugggauugauguagcagaucuuuucccugcucaaccuggcuugaccagugcagucauugaagcccuuccucgcaauaugguacugaccugucaggguucagacgauauuaagagacucuuagauucacaaggaagaagggacauaaagcuuauugacauugcacugagcaaggcugacucuaggaaguuugagaaugcuguuugggaucaaugcaaggaucuaugccauaugcauacuggggugguuguugaaaagaagaaaagaggaggcaaagaagaaauuaccccacacugugcucuaauggauugcauaauguaugaugcagcuguaucaggagggcucaauauaccaguuuugagagcaguucuccccagagacaugguguuuagaacaucaagccccaaagucguccuguaa

SEQ ID NO: 688 - RNA, 1710 nt, Artificial Sequence
  derived and/or modified CDS sequence (wt) from Lassa virus__AIT17569__NP
augagugcuucuaaggaagugaagucauuccucuggacacagucauuaaggagggagcuuucagguuacugcuccaacauaaaacuucaaguuguuaaggaugcucaggcucuccuucauggucuugacuuuucugaagucagcaaugugcagcgcuuaaugcgcaaacaaaaaagggaugacagugaucugaaacgucucagagauuugaaucaggcugucaacaaucuuguagaacucaaaucgacacaacaaaagaguaucuugagaguugggaccuugaccucagaugaccugcugacauuggcagcugacuuagagaaacuaaagucgaaggucauuagaacagaaaggccacuaagcucagguguuuauauggggaauuugagcacacagcagcuugagcagagaagagcauugcugaacaugauaggcaugguugguggggcucagggcacccaaccugggagagacggaguugugagggugugggauguuaagaauccagaccuuuugaacaaccaguucggcaccaugccuagucugacauuagcaugucucaccaaacaaggucaaguugauuugaaugaugccgucuuggcacuaacagaccugggucuaauauauacagcuaaguucccaaauagcucugaccuggauagacuuucccaaagccauccuauacugaauaugguggacacuaagaaaagcuccuuaaacauuucugguuacaacuucagcuuaggagcugcaguaaaagcuggagcuuguaugcuugauggggggaacauguuggagaccaucaagguuacaccucagacaauggauggcaucuugaagucuauuuuaaagguaaaaaaaucuuuggggauguuuguuucagauacaccuggugagaggaacccuuaugagaacauacuuuacaagaucugucuuuccggugacggcuggcccuacauagcuucaagaacuucuauuguggguagagcuugggagaauacuacuguggaucucgagucagaugggaaaccgcaaaaagugggcacuacuggguccaacaagucuuuacagucagcgggguucccaacagggcugaccuacucucaguugaugacacuuaaagacucaaugaugcagcuugacccaagugccaaaacuuggauagacauugaaggucguccagaagacccuguggaaauagcucuuuaccaaccuaugucaggcuguuauauacacuuuuucagagagccaacagacuuaaaacaguucaagcaagaugccaaauauucucaugggauugauguggcagaucuuuucccugcucaaccugguuugaccagcgcagucauugaagcccucccucgcaauauggugcugaccugccaagguucagaugauauuaagagacucuuggacucucaaggaagaagggauauaaagcuuauugacauugcacugagcaaggcugacucuaggagauuugaaaaugcuguuugggaucaaugcaaagaucuaugccauaugcacacuggagugguggucgaaaagaagaaaagagggggcaaagaggagaucaccccgcacugugcuuuaauggacugcauaauguaugaugcagcugugucaggaggacucaaucuaccaguuuuaagagcaguucuccccagggacaugguguuuagaacuucaagccccaaggucguccuguaa

SEQ ID NO: 689 - RNA, 1710 nt, Artificial Sequence
  derived and/or modified CDS sequence (wt) from Lassa virus__AIT17573__NP
augagugcuucuaaggaaguuaagucauuucucuggacacagucauugagaagggaacuuucagguuauugcuccaacauaaagcuucaaguugucaaagaugcucaggcucuccuucauggucuugacuuuucugaagucagcaaugugcagcgcuuaaugcgcaaacagaaaagggaugauagugaucugaaacgucuuagagaucugaaucaggcugucaacaaucuuguggaacuuaaaucaacacaacaaaagaguaucuugagaguugggaccuuaaccucagaugaccugcuaacauuggcagcugacuuagagaaacugaagucaaaggucauuagaacagaaagaccacuaagcucaggugucuacauggggaauuugaguacacagcagcuugagcagagaagagcauuguugaacaugauaggcaugguugguggggcucagggcacccaaccuggaagagauggaguugucagggugugggauguuaaaaacccggaucuuuugaacaaccaguuuggcaccaugccuagucugacauuagcaugucucaccaaacaaggucaaguugauuugaaugaugcugucuuagcacuaacagaccugggucuaauauacacagcuaaguacccaaauagcuccgaccuggacagacuuucccaaagucauccuauacugaacaugguggacacuaagaaaagcuccuugaacauuucugguuacaacuucagcuuaggagcugcagugaaagcuggagcuuguaugcuugauggggggaacauguuggagaccaucaagguuacaccccagacaauggaugguauccugaagucuauuuuaaagguaaaaaaauccuugggaauguuuguuucagauacaccuggugagaggaacccuuaugagaacauacuuuacaagaucugccuuuccggugacgguuggcccuacauagcuucuagaaccucuauuguagguagagcuugggagaauacuaccguggaucucgagucagauggaaaaccacaaaaagugggcacugcugggucuaacaagucuuuacaaucagcgggguuuccaacagggcugaccuauucucaguugaugacacuuaaagacucaaugaugcagcuugacccaagugccaaaaccuggauagacauugaaggucguccagaggacccuguggaaauagcucuuuaccaaccuaugucgggcuguuacauacacuucuucagagaaccaacagacuuaaaacaguucaaacaagaugccaaauauucucaugggauugauauagcagaucuuuucccugcucagccuggcuugaccagugcagucauugaagcccucccccgcaauauggugcugaccugucaagguucagaugauauuaagagacuuuuggauucucaagggagaagggacauaaagcucauugacauugcauugagcaaggcugacuccaggagauuugaaaaugcuguuugggaucagugcaaagaucuaugccauaugcacacuggaguggucgucgaaaagaagaaaagagggggcaaagaagaaauuaccccgcauugugcuuuaauggacugcauaauguaugaugcagcugugucaggaggacucaauauaccaguuuuaagagcaguucucccuagagauaugguguuuagaaccucaagccccaaagucguccuguaa

SEQ ID NO: 690 - RNA, 1710 nt, Artificial Sequence
  derived and/or modified CDS sequence (wt) from Lassa virus__AIT17577__NP
augagugcuuccaaggaagugaagucauuucucuggacacagucauugaggagggagcuuucagguuauugcuccagcauaaaacuucaaguuguuaaggaugcucaggcucuccuucauggucuugacuuuucugaagucagcaaugugcaacgcuuaaugcgcaaacaaaaaagggaugauagugaucugaaacgucuuagagauuugaaucaggcugucaacaaucuuguagaacucaaaucgacgcaacaaaagagcaucuugagaguugggacccugaccucagaugaccuguugacguuggcagcugacuuagagaaacuaaagucgaaggucauuagaacagaaaggccacuaagcucagguguuuauauggggaauuuaaguacacagcagcuugagcaaagaagagcauugcugaacaugauaggcaugguugguggggcucagggcacccaaccuggaagagacggaguuguuagggugugggauguuaagaacccggaucuucugaacaaccaguucggcaccaugccuagucugacauuagcaugucucaccaaacaaggucaaguugauuugaaugaugccgucuuagcacugacagaccugggucuaauauacacagcuaaguauccaaauagcuccgaccuggacagacucucccaaagccauccuauacugaauaugguggacaccaagaagagcuccuugaacauuucugguuauaacuucaguuuaggagcugcagugaaagcuggagcuuguaugcuugauggggggaacauguuggagaccaucaagguuacaccucagacaauggauggcaucuugaagucuauuuuaaagguaaaaagauccuugggaauguuuguuucagacacaccuggugagaggaacccuuacgagaacauacuuuauaagaucugucuuuccggugacggcuggccuuacauagcuucaaggacuucuauugcggguagagcuugggagaauacuacuguggaucucgagucagauggaaaaccacaaaaagugggugcugcuggguccaacaagucuuuacagucagcgggguuuccaacggggcugaccuauucucaguugaugacacuuaaggacucaaugaugcaacuugacccaagugccaaaacauggauagacauugaaggucguccagaagauccuguggaaauagcucuuuaccaacccaugucgggcuguuacauacacuucuucagagaaccaacagauuuaaaacaguucaagcaagaugccaaguauucucacgggauugauguggcagaucuuuucccugcucaaccuggccugaccagugcaguuauugaagcccuuccucgcaacaugguacugaccugucaagguucagaugauauuaagagacucuuggacucucagggaaggagggacauaaagcuuauugacauugcacugaguaaggcugacucuaggagauuugaaaaugcuguuugggaucagugcagggaucugugccauaugcauacuggagugguugucgaaaagaagaaaagaggagguaaagaagaaauuaccccgcacugugcuuugauggacugcauaauguaugaugcagcugugucagggggacucaauauaccaguuuuaagagcaguucuccccagagacaugguguuuagaaccucaagccccaaggucguccuguaa

SEQ ID NO: 691 - RNA, 1710 nt, Artificial Sequence
  derived and/or modified CDS sequence (wt) from Lassa virus__AIT17581__NP
augagugcuuccaaggaagugaagucauuucucuggacacagucauugaggagggagcuuucagguuauugcuccagcauaaagcuucaaguugucaaggaugcucaggcucuucuucauggucuugacuuuucugaaguuagcaaugugcagcgcuuaaugcgcaaacaaaaaagggaugauagugaucugaaacgucucagagaucugaaucaggcugucaacaaucuuguggaacucaaaucaacacaacaaaagagugucuugagaguuggaaccuugaccucagaugaccugcugacauuggcagcugacuuagagaaacuaaagucgaaggucaucagaacagaaaggccacuaagcucagguguuuauauggggaauuugagugcacagcaacuugagcaaagaagaacauugcugaacaugauaggcaugguugguggggcucagggcacucaaccuggaagagacggaguuguuagggugugggauguuaagaauccagaucuuuugaacaaucaguucggcaccaugcccagucugacauuagcaugucucacuaaacaaggccagguugauuugaaugaugucgucuuagcacuaacagaccugggucuaauauacacagcuaaguacccuaauagcuccgaccuggacagacuuucccaaagucauccuauauugaguaugguggacaccaagaagagcuccuugaacauuucugguuacaacuucagcuuaggagcugcagugaaagcuggagcuuguaugcuugauggggggaacauguuggaaaccaucaagguuacaccucagacaauggauggcaucuugaagucuauuuuaaagguaaaaaaauccuugggaauguuuguuucagacacaccuggugagaggaacccuuaugagaacauacuuuacaagaucugucuuucuggugacgguuggcccuauauagcuucaaggacuucuauuguggguagagcuugggagaauacuacuguggaucucgagucagauggaaaaccacaaaaagugggaacugcuggguccaauaagucuuuacagucagcgggguuuccaacagggcugacuuacucucaguugaugacacuuaaagacucaaugaugcagcuugacccaagugccaaaaccuggauagacauugaaggucguccagaagacccuguggaaauagcucuauaccagcccaugucgggcugcuacauacacuucuucagagaaccaacagacuuaaaacaguucaagcaagaugccaaauauucucauggaauugauguaacagaucuuuucccugcucaaccuggauuaaccagugcagucauugaagcccucccucgcaauaugguacugaccugucaagguucagaugacaucaagcgacucuuggauucccaaggaaggagggacauaaagcuuauugacauugcauugagcaaggcugacucuagaagauuugaaaaugcuguuugggaucagugcaaagaucuaugccauaugcacacuggagugguugucgaaaagaagaaaagaggaggcaaagaagaaauuaccccacauugugcucuaauggacugcauaauguaugaugcagcugugucaggaggacucaauauaccaguuuugagagcaguccuccccagagacaugguguuuagaaccucaagccccaaggucguccuguaa

SEQ ID NO: 692 - RNA, 1710 nt, Artificial Sequence
  derived and/or modified CDS sequence (wt) from Lassa virus__AIT17589__NP
augagugcuuccaaggaaguaaagucauuccucuggacacagucauugaggagggaacucucagguuacugcucuaguauaaagcuucaaguuguuaaggaugcucaggcucuccuucauggucuugacuuuucugaggucagcaauguucagcgcuugaugcgcaaacaaaaaagggacgacagugaucugaaacgucucagagaucugaaccaggcugucaacaaucuuguagaacucaaaucaacacaacaaaagaguauccugagaguugggaccuugaccucagaugaccugcugacauuggcagcugacuuagagaaacuuaagucgaaggucaucagaacagaaaggccacuaagcucagguguuuacauggggaauuugagugcacagcaacuugagcaaagaagagcauugcugaacaugauaggcaugguugguggagcucaggguacccaaccuggaagagacggaguuguuagggugugggaugucaagaauccggaucuuuugaacaaccaauucggcaccaugccuagccugacauuagcaugucucaccaaacaaggucaaguugauuugaaugaugcugucuuggcacuaacagaccugggucuaauauacacagcuaaguacccaaacagcuccgaccuggacagacuuucccaaagccauccuauacugaauaugguggacacuaagaagagcuccuugaacauuucugguuacaacuucaguuuaggagcugcagugaaagcuggagcuuguaugcuugauggggggaauauguuggagacuaucaagguuacaccucagacaauggauggcaucuugaaaucuaucuuaaagguaaaaagaucuuugggaauguuuguuucagacacaccuggugagaggaacccuuaugagaacauacuuuacaagaucugucuuucuggggacgguuggcccuacauagcuucaagaacuuccauuguggguagagcuugggagaacaccacuguggaucucgagucagauggaaaaccacaaaaggugggcacuacuggguccaacaagucuuuacagucagcgggguucccaacaggguugaccuauucucaguugaugacacuuaaagacucaaugaugcaacuugacccaagugcuaaaaccuggauagacauugaaggucgaccagaagacccuguggaaauagcucuuuaccaaccuaugucgggcuguuacauacacuucuucagagaaccaacagacuuaaaacaguucaagcaagaugccaaauauucucaugggauugauguagcagaucuuuucccugcucaaccuggcuugaccagugcagucauugaagcccuuccucgcaauauggugcugaccugucaggguucagacgauauuaagaaacucuuagauucccaaggaagaagggacauaaagcuuauugacauugcacugaguaaggcugacucuaggaaguuugaaaaugcuguuugggaccaaugcaaggaucuaugccauaugcauacuggggugguuguugaaaagaagaaaagaggaggcaaagaagaaauuaccccgcacugugcucuaauggauugcauaauguaugaugcagcugugucaggaggacucaauauaccaguuuugagagcaguucuccccagagacaugguguuuagaaccucaagccccaaggucguccuguaa

SEQ ID NO: 693 - RNA, 1710 nt, Artificial Sequence
  derived and/or modified CDS sequence (wt) from Lassa virus__AIT17593__NP
augagugcuucuaaggaagugaaaucauuucucuggacacagucauugaggagggagcuuucagguuauugcuccagcauaaaacuucaaguugucaaggaugcucaggcucuccuucauggucuugacuuuucugaaguuagcaaugugcagcgcuuaaugcgcaaacaaaagagggaugauggugaucugaaacgucucagagauuugaaucaggcugucaacaaucuuguagaacucaagucgacacaacaaaagagcaucuugagaguugggaccuugacuucagaugaccugcugacauuggcagcugacuuagagaaacuaaagucgaaggucauuagaacagaaaggccacuaagcucagguguuuauauggggaauuugaguucacagcagcuugagcaaagaagagcauugcugaacaugauaggcaugguugguggggcucagggcacccagcccggaagagacggaguuguuagggucugggauguuaagaauccggaucuuuugaauaaucaguucggcaccaugccuagucugacauuagcaugucucacuaagcaaggucaaguugauuugaaugaugcugucuuagcacuaacagaccugggucugauauacacagcuaaguauccaaauagcuccgaccuagacagacuuucccaaagccauccuauacugaauaugguggacacgaagaagagcuccuugaacauuucugguuacaacuucagcuuaggagcugcagugaaagcuggagcuuguaugcuugauggggggaacauguuggaaaccauuaagguuacaccucagacaauggauggcaucuugaagucuauuuuaaaggugaaaagaucuuugggaauguuuguuucagauacaccuggugagaggaacccuuacgagaacauacuuuauaagaucugucuuuccggugacggcuggcccuacauagcuucaagaacuucuauuguggguagagcuugggagaauacaacuguggaucucgagucggauggaaaaccacaaaaagugggugcugcuggguccaccaagucuuuacagucagcgggguuuccaacagggcuaaccuauucucaguuaaugacacuuaaagacucaaugaugcagcuugacccaagugccaaaaccuggauagacauugaaggucguccagaagacccuguggaaauagcucuuuaccaaccuaugucgggcuguuacauacacuucuucagagaaccaacagauuuaaaacaguucaagcaagaugccaaauauucucaugggauugauguggcagaucuuuucccugcucaaccugguuugaccagugcagucauugaagcccucccucgcaauauggugcugaccugucaagguucagaugauauuaagagacucuuggacucccaaggaagaagggacauaaagcuuauugacauugcacuaagcaagguugacucuaggagauuugaaaaugcuguuugggaucaaugcaaagaucuaugccauaugcauacuggaguuguugucgaaaagaagaaaagagggggcaaagaagaaauuacuccgcacugugcuuuaauggacugcauaauguaugaugcagcugugucaggaggacucaauauaccaguucuaagagcaguucuccccagagacaugguguuuagaaccucaagccccaaggucguccuguaa

SEQ ID NO: 694 - RNA, 1710 nt, Artificial Sequence
  derived and/or modified CDS sequence (wt) from Lassa virus__AIT17605__NP
augagugcuuccaaggaagugaagucauuucucuggacacagucauugaggagggagcuuucagguuauugcuccagcauaaaacuucaaguuguuaaggaugcucaggcucuccuucauggucuugacuuuucugaggucagcaaugugcagcgcuuaaugcgcaaacaaaaaagggaugauagugaucugaaacgucucagagaucuaaaucaggcugucaacaaucuuguagaacucaaaucaacacaacaaaagaguaucuugagaguugggacccugacuucagaugaccugcugacauuggcggcugacuuggagaaacuaaagucgaaggucauuagaacagaaaggccacuaagcucaggugucuauauggggaauuugaguacacagcagcuugaacaaagaagagcauuguugaacaugauaggcauggcugguggggcucaaggcacccaaccuggaagagacggaguugucagggugugggauguuaagaauccggaucuuuugaacaaccaguucggcaccaugccuagucuaacauuagcaugucucaccaaacaaggucaaguugauuugaaugaugccgucuuagcacuaacagaccugggucuaauauacacagccaaguacccaaauagcuccgacuuggacagacuuucccagagccauccuauacugaauaugguagacacuaagaagaguuccuugaacauuucugguuacaacuucagcuuaggagcugcagugaaagcuggagcuuguaugcuugaugggggaaacauguuggagaccaucaagguuacaccucagacaauggauggcaucuugaaaucuauuuuaaagguaaaaaaguccuugggaauguuuguuucagauacaccuggugagaggaacccuuaugagaauauacuuuacaagaucugucuuucuggugacggcuggcccuacauagcuucaaggacuuccauuguggguagagcuugggagaauacuacuguggaucucgagucagaugggaaaccacagaaagugggcacugcuggguccaacaagucuuuacagucagcgggguucccaacagggcugaccuauucucagcugaugacacucaaagacucaaugaugcaacuugauccaagugccaaaaccuggauagacauugaaggucguccagaagacccuguagaaauagcucuuuaccaaccuaugucgggcuguuacauacacuucuucagagaaccaacagacuuaaaacaguucaaacaagaugccaaauauucucaugggauugauguagcagaucuuuucucugcucaaccugguuugaccagugcagucauugaagcccucccucgcaacaugguacugaccugucaagguucagaugauaucaagagacucuuggacucccaaggaagaagggacauaaagcuuauugacauugcauugagcaaggccgauuccaggagauuugaaaaugcuguuugggaucagugcaaagaucuaugccauaugcauacuggagugguugucgaaaagaagaaaagaggaggcaaagaagaaauuaccccgcacugugccuuaauggacugcauaauguaugaugcagcugugucaggaggacucaauauaccaguuuuaagagcaguucuccccagagacaugguguuuagaaccucaagccccaaggucguccuguaa

SEQ ID NO: 695 - RNA, 1710 nt, Artificial Sequence
  derived and/or modified CDS sequence (wt) from Lassa virus__AIT17609__NP
augagugcuuccaaggaagugaagucauuucucuggacacaaucauugaggagggagcuuucagguuauugcuccagcauaaaacuucaaguuguuaaggaugcucaggcucuccuucauggucuugacuuuucugaagucagcaaugugcagcgcuuaaugcgcaaacaaaagagggaugauagugaucugaaacgucucagagauuugaaucaggcugucaacaaucuuguagagcucaaaucgacacaacaaaagagcaucuugagaguugggaccuugaccucagaugaccugcugacacuggcagcugacuuagagaaacuaaagucaaaggucauuagaacagaaaggccacuaagcucagguguuuauauggggaauuugaguacacagcagcuugagcaaagaagagcauugcugaacaugauaggcauggcugguggggcucagggcacccagccugggagagacggaguugucagggugugggauguuaagaauccggaucuuuugaacaaucaguucggcaccaugccuagucugacauuagcaugucucaccaaacaaggucaaguugauuugaaugaugcugucuuagcacuaacagaccugggucuaauauacacagcuaaguauccaaauagcuccgaccuggacagacuuucucaaagccauccuauacugaauaugguggacacuaagaagagcucuuugaacauuucugguuacaacuucagcuugggagcugcagugaaagcuggagcuuguaugcuugauggggggaacauguuggagaccauuaagguuacaccucagacaauggauggcaucuugaagucuauuuuaaagguaaaaagaucuuugggaauguuuguuucagauacaccuggugagaggaacccuuacgagaacauacuuuacaagaucugucuuucuggugacggcuggcccuacauagcuucaaggacuuccauuguggguagagcuugggagaacacuaccguggaucucgagucagauggaaaaccacaaaaagugggugcugcuggguccaacaagucuuuacagucagcaggguuuccaacagggcugaccuauucucaguugaugacacuuaaagacucaaugaugcagcuugacccaagugccaaaaccuggauagauauugaaggucguccagaggacccuguggaaauagcucuuuaccaaccuaugucaggcuguuacauacacuucuucagagaaccaacagauuuaaaacaguucaagcaagaugccaaauauucucaugggauugauguggcagaucuuuucccugcucaaccugguuuaaccagugcagucauugaagcccuuccucgcaauaugguacuaacuugucaagguucagaugauauuaagagacucuuggacucccaaggaagaagggacauaaagcuuauugacauugcacugagcaaggcugacucuaggagauuugaaaaugcuguuugggaucagugcaaagaucuaugccauaugcauacuggagugguugucgaaaagaagaaaagaggagguaaagaagaaauuaccccgcacugugcuuuaauggacugcauaauguaugaugcagcugugucaggaggacucaauauaccagucuuaagagcaguucuccccagagacaugguguuuagaaccucaagccccaaggucguccuguaa

SEQ ID NO: 696 - RNA, 1710 nt, Artificial Sequence
  derived and/or modified CDS sequence (wt) from Lassa virus__AIT17613__NP
augagugcuucuaaggaagugaagucauuucucuggacacagucauugaggagggagcuuucagguuauugcuccaauauaaaacuucaaguuguuaaggaugcucaggcucuucuucauggucuugacuuuucugaagucagcaaugugcagcgcuuaaugcgcaaacagaagagggaugauagugaucugaaacgucucagagauuugaaucaggccgucaacaaucuuguagaacucaaaucgacacaacagaagagcauccugagaguugggaccuugaccucagaugaccugcuaacauuggcagcugacuuagagaaacuaaagucgaaggucauuagaacagaaaggccacuaagcucagguguuuauauggggaauuugaguacacagcagcuugagcaaagaagagcacugcugaacaugauaggcaugguugguggggcucagggcacacaaccuggaagagauggaguuguuagggugugggauguuaagaacccggaucuuuugaacaaucaguucggcaccaugcccagucugacauuagcaugucuuacuaaacaaggucaaguugauuugaaugaugcugucuuggcacuaacagaccugggucugauauacacagcuaaguauccaaauagcuccgaccuagacagacuuucccaaagucauccuauauugaauaugguggacacuaagaagagcuccuugaauauuucugguuacaacuucagcuuaggagccgcagugaaagcuggagcuuguaugcuugauggagggaacauguuggagaccauuaagguuacaccucagacaauggauggcaucuuaaagucuauuuuaaaggugaaaagaucuuugggaauguuuguuucagacacaccuggugagaggaacccuuacgagaacauacuuuacaaaaucugucuuuccggugacggcuggccuuacauagcuucaaggacuucuauuguggguagagcuugggagaauacuacuguggaucucgagucagacggaaaaccacaaaaaguggguacugcuggguccaacaagucuuuacagucagcgggguuuccaacagggcugaccuauucucaguugaugacacuuaaagacucaaugaugcagcuugacccaagugccaaaaccuggauagacauugaaggucguccagaagacccuguagaaauagcucuuuaccaaccuaugucgggcuguuacauacacuucuucagagaaccaacagauuuaaaacaguucaaacaagaugccaaauauucucaugggauugauguggcagaucucuucccugcucaaccugguuugaccagugcagucauugaagcccucccucgcaauaugguguugaccugucaagguucagaugauauuaagagacucuuggacucccaaggaagaagggacauaaagcuuauugacauugcacugagcaagacugacucuaggagauuugaaaaugcuguuugggaucagugcaaagaucuaugucauaugcauacuggagugguuguugaaaagaagaagagaggaggcaaagaagaaauuaccccgcauugugcuuuaauggacugcauaauguaugaugcagcuguaucaggaggacucaauauaccaguuuuaagagcaguucuccccagagacaugguguuuaggacuucaagccccaaggucguccuguaa

SEQ ID NO: 697 - RNA, 1710 nt, Artificial Sequence
  derived and/or modified CDS sequence (wt) from Lassa virus__AIT17617__NP
augagugcuucuaaggaagugaagucauuucuuuggacacagucauugaggagggagcuuucagguuauugcuccagcauaaaacuucaaguugucaaagaugcucaggcucuccuucauggucuugacuuuucugaagucagcaaugugcagcgcuuaaugcgcaaacagaagagggaugauagugaucugaaacgucucagagauuugaaucaggccgucaacaaucuuguagaacucaaaucgacacaacaaaagagcaucuugagaguugggaccuugaccucagaugaccugcugacacuggcagcugacuuagagaaacuaaagucgaaggucauuagaacagaaaggccacuaagcucagguguuuauauggggaauuugagugcucagcagcuugagcaaaggagagcauugcugaacaugauaggcauggucgguggggcucagggcacucaaccuggaagggauggaguuguuagggugugggauguuaagaauccggaucuuuugaacaaucaguucggcaccaugcccagucugacauuagcaugucuuacuaaacaaggucaaguugauuugaaugaugcugucuuagcacuaacagaccugggucuaauauacacagcuaaguauccaaauagcucugaccuagacagacuuucccaaagccauccuauacugaauaugguggacacuaagaagagcuccuugaauauuucugguuucaacuucagcuuaggagcugcagugaaagcuggagcuugcaugcuugauggggggaacauguuggagaccauuaagguuacaccucagacaauggauggcaucuuaaaguccauucuaaaggugaaaagaucuuugggaauguuuguuucagauacaccuggugagaggaacccuuacgagaacauacuuuacaagaucugucuuuccggugauggcuggcccuacauagcuucaagaacuucuauuguggguagagcuugggagaauacuacuguggaucucgagucagauggaaaaccacaaaagguggguacugcuggguccaauaagucuuuacagucagcaggguuuccaacagggcugaccuauucccaauugaugacacuuaaagacucaaugaugcagcuugacccaagugccaaaaccuggauagacauugaaggucgaccagaagacccuguagaaauagcucuuuaccaaccuaugucgggcuguuacauacacuucuucagagagccaacagauuuaaaacaguucaagcaagaugccaaauauucucaugggauugauguggcagaucuuuucccugcccaaccugguuugaccagugcagucauugaagcccucccucgcaauaugguacugaccugucaagguucagaugauaucaagagacucuuggacucccagggaaggagggacauaaagcuuauugacauugcacugagcaaggcugauucuaggagauuugaaaaugcuguuugggaucaguguaaagauuuaugccauaugcauacuggagugguugucgaaaagaagaaaagaggaggcaaagaagaaauuacuccgcacugugcuuuaauggacugcauaauguaugaugcagcugugucaggaggacucaauauaccaguuuuaagagcaguucucccuagagacaugguguuuagaaccucaagccccaaggucguccuguaa

SEQ ID NO: 698 - RNA, 1710 nt, Artificial Sequence
  derived and/or modified CDS sequence (wt) from Lassa virus__AIT17621__NP
augagugcuucuaaggaagugaagucauuucucuggacacagucauuaaggagggagcuuucagguuauugcuccagcauaaaacuucagguuguuaaggaugcucaggcucuccuucauggucuugacuuuucugaagucaccaauguucaacgcuugaugcgcaaacaaaagagggaugauagugaucugaaacgucucagagauuugaaucaggcugucaacaaucuuguagaacucaaaucgacacaacaaaagagcaucuugagaguugggaccuugaccucagaugaccugcugacauuggcagcugacuuagagaaauuaaagucgaaggucauuagaacagaaaggccacuaagcucagguguuuacauggggaauuugaguacacagcagcuugagcaaagaagagcauugcugaacaugauaggcaugguugguggggcucagggcacccaaccuggaagagacggaguuguuagggugugggacguuaaaaauccggaucuuuugaacaaucaguucggcaccaugccuagucugacauuagcaugucucaccaaacaaggucaaguugauuugaaugaugcugucuuagcacuaacagaccugggucuaauauacacagccaaguauccaaauagcuccgaccuggacagacuuucccaaagccauccuauacugaauaugguggacacuaagaagagcuccuugaacauuucugguuauaacuucagcuuaggagcugcagugaaagcuggagcuuguaugcuugauggggggaacauguuggagaccauuaagguuacaccucagacaauggacggcauuuugaagucuauuuuaaagguaaaaaggucuuugggaauguuuguuucagauacaccuggugagaggaacccuuacgagaacauacuuuacaagaucugucuuuccggugacggcuggcccuacauagcaucaaggaccucuauuguggguagagcuugggagaauacuacuguggaucuugaaucagauggaaaaccacaaaagguggguauugcuggguccaacaagucuuuacagucagcgggguuuccaacagggcugaccuauucucaguugaugacacuuaaagacucaaugaugcagcuugacccaagugccaaaaccuggauagacauugaaggucguccagaagacccuguagagauagcucuuuaucaaccuaugucgggcuguuacauacacuucuucagagaaccaacagacuuaaaacaguucaagcaagaugccaaauacucucaugggauugauguggcugaucuuuucccugcucagccugguuugaccagugcagucauugaagcccucccucgcaauauggugcuaaccugucaagguucagaugauaucaagagacucuuggacucccaaggaagaagggacauaaagcuuauugacauugcacugagcaaggcugauucuaggaaauuugaaaaugcuguuugggaucagugcaaagaucuaugccauaugcacacuggagugguugucgaaaagaagaagagaggaggcaaagaagaaauuaccccgcacugugcuuuaauggacugcauaauguaugaugcagcugugucaggaggacucaacauaccaguuuuaagagcaguucuacccagagacaugguguuuagaaccucaagccccaaggucguccuguaa

SEQ ID NO: 699 - RNA, 1710 nt, Artificial Sequence
  derived and/or modified CDS sequence (wt) from Lassa virus__AIT17625__NP
augagugcuucuaaggaaguaaagucauuucucuggacacagucauugaggagggagcuuucagguuauugcuccagcauaaaacuucaaguuguuaaggaugcucaggcucuccuucauggucuugacuuuucugaagucagcaaugugcagcgcuuaaugcgcaaacaaaggagggaugauagugaucugaaacgucucagagauuugaaucaggcugucaacaaucuuguagaacucaaaucgacacaacaaaagagcaucuugagaguugggaccuugaccucggaugaccugcugacauuggcagccgaccuagaaaaacuaaagucgaaggucauuagaacagaaaggccacuaagcucagguguuuauauggggaauuugagcacacagcagcuugagcaaagaagagcauugcugaacaugauaggcaugguugguggggcccagggcacccaaccuggaagggacggaguuguuagagugugggauguuaagaauccggaucuuuugaacaaucaguucggcaccaugccuagucugacauuagcaugucucaccaaacaaggccaaguugauuugaaugaugcugucuuggcacuaacagaucugggucuaauauacacagcuaaguauccaaauagcuccgaccuggacagacuuucccaaagccauccuauacugaacaugguggacaccaagaagagcuccuugaacauuucuggcuacaacuucagcuuaggagcugcagugaaagcuggagcuuguaugcuugaugggggaaacauguuggagaccauuaaggucacaccucagacaguggauggcaucuugaagucuauuuuaaagguaaaaagaucuuugggaauguuuguuucagauacaccuggugagaggaacccuuacgagaacauacuuuacaagaucugucuuucuggcgacggcuggcccuacauagcuucaaggacuucuauuguggguagagcuugggagaauacuacuguggaucucgagucagauggaaaaccacagaaaguggguacugcuggguccaacaagucuuuacagucagcgggguuuccaacagggcugaccuauucucaguugaugacacuuaaagacucgaugaugcagcuugacccaagugccaaaaccuggauagacauugagggucguccagaagacccuguggaaauugcucuuuaccaaccuaugucuggcuguuacauacacuucuucagagaaccaacagauuuaaaacaguucaagcaagaugccaaauauucucaugggauugauguggcagaucuuuucccugcucaaccugguuugaccagugcagucauugaagcucucccucgcaacaugguacugaccugucaagguucagaugauauuaagagacucuuggacucccaaggaagaagggacauaaagcuuauugacauugcacugagcaaggcugauucuaggaaauuugaaaaugcuguuugggaucagugcaaagaucuaugccauaugcauacuggagugguugucgaaaagaagaaaagaggagguaaagaagaaaucaccccgcacugugcuuuaauggacugcauaauguaugaugcagcugugucaggaggacucaacauaccaguucuaagagcaguucuccccagagacaugguguuuagaaccucgagccccaaagucguccuguaa

SEQ ID NO: 700 - RNA, 1710 nt, Artificial Sequence
  derived and/or modified CDS sequence (wt) from Lassa virus__AIT17627__NP
augagcgcuucuaaggaggugaagucauuucucuggacacagucauugaggagggagcuuucagguuauugcuccaguauaaaacuucaaguuguuaaggaugcucaggcucuucuucauggucuugacuuuucugaagucagcaaugugcagcgcuuaaugcgcaagcaaaagagggaugauagugaucugaaacgucucagagauuugaaucaggcugucaacaaucuuguagaacucaaaucgacacaacaaaagagcauccugagaguugggaccuugacuucagaugacuugcugacacuggcagcugacuuagaaaaacuaaagucgaaggucauuagaacagaaaggccacuaagcucagguguuuauauggggaauuugaguucacagcagcuugagcaaagaagagcacugcugaacaugauaggcaugguugguggggcucagggcacccaaccuggaagagacggaguuguuagggugugggauguuaagaauccggaucuuuugaacaaucaguucggcaccaugccuagucugacacuggcaugucucaccaaacaaggucaaguugauuugaaugaugccgucuuggcauuaacagaccugggucugauauacacagccaaguacccaaauagcuccgaccuggacagacuuucccaaagccaucccauacugaauaugguggacaccaagaagagcucuuugaacauuucugguuacaacuucagcuugggagcugcagugaaagcuggagcuuguaugcuugauggggggaacauguuggagaccaucaagguuacaccucagacaauggauggcaucuuaaagucuauuuuaaaggugaaaagaucuuugggaauguuuguuucagauacaccuggugaaaggaacccuuacgagaacauacuuuacaagaucugucuuuccggugacggcuggcccuauauagcuucaaggacuuccauuguggguagagcuugggagaauacuacuguggaucucgagucagaugggaaaccacaaaaaguggguucugcugggucuaacaagucuuuacagucagcaggauuuccaacaggguugaccuauucucaguugaugacacuuaaagacucaaugaugcagcuugacccaagugccaaaaccuggauagacauugagggucguccggaagacccuguggaaauagcucuuuaccaaccuaugucgggcuguuacauacacuucuucagagaaccaacagauuuaaaacaguucaagcaagaugccaaguauucucaugggauugauguggcagaucuuuucccugcucaaccuggucugaccagugcagucaucgaagcucucccucguaauaugguacugaccugucaagguucagaugauauuaagagacucuuggacucccaaggaagaagagacauaaagcuuauugacaucgcauugagcaaggcugacucuagaagauuugaaaaugcuguuugggaucaguguaaagaucuaugccauaugcauacuggagugguuguugaaaagaagaaaagaggaggcaaagaagaaauuaccccgcacugugcuuuaauggacugcauuauguaugaugcagcugugucaggaggacucaacauaccaguuuuaagagcaguucuccccagagacaugguguuuagaaccucgagccccaaagucguccuguaa

SEQ ID NO: 701 - RNA, 1710 nt, Artificial Sequence
  derived and/or modified CDS sequence (wt) from Lassa virus__AIT17631__NP
augagugccuccaaggaaauaaagucauuccuuuggacacaguccuugaggagggagcuaucagguuacugcuccagcauaaagcuucaaguuguuaaggaugcucaggcucuccuucauggucuugacuuuucugaagucagcaauguucagcgcuugaugcgcaaacaaaaaagggacgacagugaucugaaacgucucagagaucugaaccaggcugucaacaaucuuguagaacucaaaucaacacaacaaaagaguauccugagaguugggaccuugaccucggaugaccuguugacauuggcagcugacuuagagaaacuuaagucgaaggucaucagaacagaaaggccacuaagcucagguguuuacaugggaaauuugaguacacagcaacuugagcaaagaagagcauugcugaacaugauaggcaugguugguggggcucaggguacccaaccuggaagggacggaguuguuagggugugggaugucaagaauccggaucucuugaacaaccaauuuggcaccaugcccagucugacauuggcaugucucaccaagcaaggucaaguugauuuaaaugaugcugucuuagcacuaacagaucugggucuaauauacacagcuaaguacccaaacagcuccgaccuggacagacuuucccaaagccauccuauacugaauaugguggacacuaagaagagcuccuugaauauuucuggcuacaacuucaguuuaggagcugcagugaaagcuggagccuguaugcuugauggggggaacauguuggagaccaucaagguuacaccucagacaauggauggcaucuugaaaucuaucuuaaagguaaaaagaucuuugggaauguuuguuucagaugcaccuggugagaggaacccuuaugagaacauacucuacaagaucugucuuucuggggacgguuggcccuacauagcuucaagaacuuccauuguggguagagcuugggagaacaccacuguggaucucgagucagauggaaaaccacaaaaggugggcacugcuggguccaacaagucuuuacagucagcgggguuuccaacaggguugaccuauucucaguugaugacacuuaaagacucaaugaugcagcuugacccaagugcuaaaaccuggauagacauugaaggucguccagaagacccuguagaaauagcucuuuaccaaccuaugucgggcuguuacauacacuucuucagagaaccaacagacuugaaacaguuuaagcaagaugccaaauauucucaugggauugauguagcagaucuuuucccugcucaaccuggcuugaccagugcagucauugaagcccuuccucgcaauaugguacugaccugccaggguucagacgauauuaagagacucuuagauucacaaggaagaagggacauaaagcuuauugacauugcacugagcaaggcugacuccaggagguuugagaaugcuguuugggaucaaugcaaggaucuaugccauaugcauacuggggugguuguugaaaagaagaaaagaggaggcaaagaagaaauuaccccacacugugcucuaauggauugcauaauguaugaugcagcugugucaggaggacucaauauaccaguuuugagagcaguucuccccagagacaugguguuuagaacaucaagccccaaggucguccuguaa

SEQ ID NO: 702 - RNA, 1710 nt, Artificial Sequence
  derived and/or modified CDS sequence (wt) from Lassa virus__AIT17635__NP
augagugcuucuaaggaaguaaaaucauuucucuggacacaaucauugaggagggagcuuucaggcuauugcuccaacauaaaacuucaaguuguuaaagaugcucaggcucuccuucauggucuugacuuuucugaagucagcaaugugcagcgcuugaugcgcaaacaaaaaagggaugauaaugaucuaaaacgucucagagauuugaaucaggcugucaacaaucuuguagaacuuaaaucgacacaacaaaagaguauccugaggguugggaccuugacuucagaugaccugcugacauuggcagcugacuuagagaaauuaaagucgaaggucauuagaacggaaaggccacuaagcucagguguuuauauggggaaccugaauacacagcagcuugagcaaagaagagcacugcugaacaugauagguaugguugguggagcucagggcacucaacccggaagagacggaguuguuagggugugggauguuaagaauccggaucuuuugaacaaccaguucggcaccaugcccaguuugacauuagcaugucucaccaaacaaggucaaguugauuugaaugacgccgucuuggcauuaacagaccugggucuaauauacacagcuaaguacccaaauagcuccgaucuggacagacuuucccaaagccauccuauacugaauaugguggacaccaagaagagcuccuugaacauuuccgguuacaacuucagccuaggagcugcagugaaggcuggagcuuguaugcuugauggggggaacauguuggagaccaucaagguuacaccucagacaauggauggcaucuugaagucuaucuuaaaggugaaaaaaucuuugggaauguuuguuucagauacaccuggugagagaaacccauaugagaacauacuuuacaagaucugucuuuccggugauggcuggcccuacauagcuucaaggacuuccauuguggguagagcuugggagaauacuacuguggaucuugagucagauggaaaaccacaaaaagugggcacugcuggguccaacaagucuuugcaaucagcgggguuuccaacagggcugaccuauucucaguugaugacacuuaaagacucaaugaugcaacuugacccaagugccaaaaccuggauagacauugaaggccguccagaagacccuguggaaauagcucuuuaccaacccaugucgggcuguuacauacacuucuucagagaaccaacagacuuaaaacaguucaagcaggaugccaaauauucucaugggauugauguagcagaccuuuucccugcccaaccugguuugaccagugcagucauugaagcccuuccucgaaauaugguacugaccugucaagguucagaugauauuaagagacucuuggacucccaaggaagaagggacauaaagcucauugacauugcacugagcaaggcugacucuaggagauuugaaaaugcuguuugggaucagugcaaagaucuaugccauaugcauacuggggugguugucgaaaagaagaaaagaggagguaaagaagaaaucaccccacacugcgcuuuaauggacugcauaauguaugaugcagcuguaucaggaggacucaacauaccaguuuuaagagcaguucuccccagggacaugguguuuagaaccucaagccccaaggucguucuguaa

SEQ ID NO: 703 - RNA, 1710 nt, Artificial Sequence
  derived and/or modified CDS sequence (wt) from Lassa virus__AIT17639__NP
augagugcuucuaaggaagugaagucauuucucuggacacagucauugaggagggagcuuucaggcuauugcuccaacauaaaacuucaaguuguuaaggaugcucaggcucuucuucauggucuugacuuuucugaagucagcaaugugcagcgcuuaaugcgcaagcaaaaaagggaugauagugaucugaaacgucucagagauuugaaucaggcugucaacaaucuuguagaacucaaaucgacacaacaaaagaguaucuugagaguugggaccuugacuucagaugaucugcugacauuggcagcugacuuagagaaacuaaagucgaaagucauuagaacagaaaggccucuaagcucagguguuuacauggggaauuugagcacacagcagcuugagcagagaagggcauugcugaacaugauaggcaugguugguggggcucaaggcacccaaccuggaagagacggaguuguuagggugugggauguuaagaauccggaucuuuugaacaaccaguucggcaccaugccuagucugacauuagcaugucucaccaaacaaggucaaguugauuugaaugaugccgucuuagcacuaacagaccugggucuaauauacacagcuaaguacccaaauagcuccgaccuagauagacuuucccaaagccauccuauacugaauaugguggacauuaagaaaagcucccugaacauuucugguuacaacuucagcuuaggagcugcagugaaggcuggggccugcaugcucgauggggggaacauguuggagaccaucaagguuacaccucagacaauggauggcaucuugaagucuauuuuaaaaguaaaaagaucuuugggaauguuuguuucagauacaccuggugagagaaacccuuaugagaacauacuuuacaagaucugucuuuccggugacggcuggcccuacauagcuucaaggacuucuauuguggguagggcuugggagaauacuacuguggaucucgagucagauggaaaaccgcaaaaagugggcucugcuggguccaacaaguccuuacagucagcgggauucccaacagggcugaccuauucucaguugaugacacuuaaagacucaaugaugcagcuugacccaagugccaaaaccuggauagacauugaaggucguccagaagacccuguggaaauagcucuuuaccaaccuaugucgggcuguuacauacacuucuucagagagccaacagacuuaaaacaguucaagcaggaugccaaauauucucaugggauugauguggcagaucuuuucccugcucaaccugguuugaccagcgcaguuauugaagcccucccucgcaauauggugcugaccugucaagguucagaugauauuaagagacucuuagacucccaaggaagaagggacauaaagcuuauugacauugcacugagcaaggcugacucuaggagauuugaaaaugcuguuugggaucaguguaaagaccuaugccauaugcauacuggagugguugucgaaaagaagaaaagaggaggcaaagaagaaauaacuccgcacugugcuuuaauggacugcauaauguaugaugcagcugugucaggagggcucaauauaccaguuuuaagagcaguucuucccagagacaugguguuuagaaccucaagccccaaggucguccuguaa

SEQ ID NO: 704 - RNA, 1710 nt, Artificial Sequence
  derived and/or modified CDS sequence (wt) from Lassa virus__AIT17643__NP
augagugcuucuaaggaagugaagucauuccucuggacacaaucauugaggagggagcuuucagguuauugcuccaacauaaagcuucagguugucaaggaugcucaggcucuccuucauggucuugacuuuucugaagucagcaaugugcagcgcuuaaugcgcaaacaaaagagagaugacagugaucugaaacgucucagagaucugaaucaggcugucaacaaucuuguagaacucaaaucaacacagcagaagagcaucuugagaguuggaaccuugacuucagaugaccugcugacauuagcagccgacuuggagaaacuaaagucgaaggucauuagaacagaaaggccacuaaguucagguguuuauauggggaauuugagugcacagcagcuugagcaaagaagagcauugcugaacaugauuggcaugguugguggagcucagggcacccaaccugggagagacggaguuguuagggugugggauguuaagaauccagaccuuuugaacaaccaguucggcaccaugccuagucugacauuagcaugucucaccaaacaaggucaaguugauuugaaugaugccguuuuagcacuaacagaccugggucuaauauacacagcuaaguacccaaacagcuccgaucuagacagacuuucccaaagccaucccauacugaauaugguggacacuaagaagagcucuuugaacauuucugguuacaacuucagcuugggagccgcagugaaagcuggggcuuguaugcuugauggggggaacauguuggagaccaucaagguuacaccucagacaauggauggcauucugaagucuauuuuaaagguaaaaaaauccuugggaauguuuguuucagauacaccuggugagaggaacccuuaugaaaauauacuuuacaagaucugucuuucuggugacgguuggcccuacauagcuucaaggacuucuauuguggguagagccugggagaacacuacuguggaucucgagucagauggaaaaccacaaaaagugggcacugcuggguccaacaaguccuuacagucagcaggguuuccaacagggcugaccuauucucaguugaugacacuuaaagauucaaugaugcagcuugacccaagugccaaaaccuggauagacauugaaggucguccagaagacccuguggaaauagcucuuuaccaaccuaugucgggcuguuacauacauuucuuuagagaaccaacagacuuaaaacaguucaagcaagaugccaaauauucucaugggauugauguagcagaucuuuucccugcucaaccugguuuaaccagugcaguuauugaagcccucccucgcaauaugguacugaccugucaagguucagaugauauuaagagacucuuggauucccaaggaagaagggacauaaagcuuauugacauugcacugagcaaggcugacucuaggagauuugaaaaugcuguuugggaucaguguaaagaucuaugccauaugcauacuggagugguagucgaaaagaagaaaagaggaggcaaagaagagauuaccccgcacugugcuuugauggacugcauaauguaugaugcagcugugucaggaggacucaauauaccaguuuuaagggcaguucuccccagagacaugguguuuagaaccucaagccccaaggucguccuguaa

SEQ ID NO: 705 - RNA, 1710 nt, Artificial Sequence
  derived and/or modified CDS sequence (wt) from Lassa virus__AIT17651__NP
augagugcuuccaaggaagugaagucauuucucuggacacagucauugaggagggagcuuucagguuauugcuccagcauaaagcuucaaguugucaaggaugcucaggcucuccuucauggucuugacuuuucugaaguuagcaaugugcagcgcuuaaugcgcaaacaaaaaagggaugauagugaucugaaacgucucagagaucugaaucaggcugucaacaaucuuguggaacuaaaaucaacacaacaaaagagugucuugagaguugggaccuugaccucagaugaccugcugacauuggcagcugacuuagagaaacuuaagucgaaggucaucagaacagaaaggccacuaagcucagguguuuauauggggaauuugagugcacagcaacuugagcaaagaagagcauuacugaacaugauaggcaugguugguggggcucagggcacccaaccuggaagagacggaguuguuagggugugggauguuaaaaauccagaucuuuugaacaaucaguucggcaccaugcccagucugacauuagcaugccucacuaaacaaggccagguugauuugaaugaugucgucuuagcacuaacagaccuaggucuaauauacacagcuaaguacccuaauagcuccgaccuggacagacuuucccaaagucauccuauauugaauaugguggacaccaagaagagcuccuugaacauuucugguuacaacuucagcuuaggagcugcagugaaagcuggagcuuguaugcuugauggggggaacauguuggaaaccaucaagguuacaccucagacaauggauggcaucuugaagucuauuuuaaaggugaaaaaauccuugggaauguuuguuucagacacaccuggugagaggaacccuuaugagaacauacuuuacaagaucugucuuucuggugaugguuggcccuacauagcuucaaggacuucaauuguggguagagcuugggagaauacuacuguggaucucgagucagauggaaaaccacaaaaagugggaacugcuggguccaauaagucuuuacagucagcgggguucccaacagggcugacuuacucucaguugaugacacuuaaagacucaaugaugcagcuugacccaagugccaaaaccuggauagacauugaaggucguccagaagacccuguggaaauagcucuuuaccagcccaugucgggcugcuacauacacuucuucagagaaccaacagacuugaaacaguucaagcaagaugccaaauauucucaugggauugauguaacagaucuuuucucugcucaaccuggauuaaccagugcagucauugaagcccucccacgcaauauggugcugaccugucaagguucagaugacaucaagcgacucuuggauucccaaggaagaagggacauaaaacuaauugacauugcauugagcaaggcugacucuaggagauuugaaaaugcuguuugggaucagugcaaagaucuaugccauaugcacacuggagugguugucgagaagaagaaaagaggaggcaaagaagaaauuaccccacauugugcucuaauggauugcauaauguaugaugcagcugugucaggaggacucaauauaccaguuuuaagagcgguccuccccagagacaugguguuuagaaccucaagccccaaggucguccuguaa

SEQ ID NO: 706 - RNA, 1710 nt, Artificial Sequence
  derived and/or modified CDS sequence (wt) from Lassa virus__AIT17655__NP
augagugcuucuaaggaagugaagucauuccucuggacacagucauugaggagggagcuuucagguuacugcuccaacauaaaacuucaaguuguuaaggaugcucaggcucuccuucauggucuugacuuuucugaagucagcaaugugcagcgcuuaaugcgcaaacaaaaaagggaugacagugaucugaaacgucucagagauuugaaucaggcugucaacaaucuuguagaacucaaaucgacacaacaaaagaguaucuugagaguugggaccuugaccucagaugaccugcugacauuggcagcugacuuagagaaacuaaagucgaaggucauuagaacagaaaagccacuaagcucagguguuuauauggggaauuugagcacacagcagcuugagcagagaagagcacugcugaacaugauaggcaugguugguggggcucagggcacccaaccuggaagagacggaguugugagggugugggauguuaagaauccagaccuuuugaacaaccaguucggcaccaugccuagucugacauuagcaugucucaccaaacaaggucaaguugauuugaaugaugccgucuuggcacuaacagaccugggucuaauauacacagccaaguucccaaauagcucugaccuggauagacuuucccaaagccauccuauacugaauaugguggacacuaagaaaagcuccuuaaacauuucugguuacaacuucagcuuaggagcugcaguaaaagcuggagcuuguaugcuugauggggggaacauguuggagaccaucaagguuacaccucagacaauggauggcaucuugaagucuauuuuaaagguaaaaaaaucuuuggggauguuuguuucagauacaccuggugagaggaacccuuaugagaacauacuuuacaagaucugucuuuccggugacggcuggcccuacauagcuucaagaacuucuauuguggguagagcuugggagaauacuacuguggaucucgagucagauggaaaaccgcaaaaagugggcacuacuggguccaacaagucuuuacagucagcgggguucccaacagggcugaccuacucucaguugaugacacuuaaagacucaaugaugcagcuugacccaagcgccaaaacuuggauagacauugaaggucguccagaagacccuguggaaauagcucuuuaccaaccuaugucaggcuguuauauacacuuuuucagagagccaacagacuuaaaacaguucaagcaagaugccaaauauucucaugggauugauguggcagaucuuuucccugcucaaccugguuugaccagcgcagucauugaagcccucccucgcaauauggugcugaccugucaagguucagaugauauuaagagacucuuggacucccaaggaagaagggauauaaagcuuauugacauugcacugagcaaggcugacucuaggagauuugaaaaugcuguuugggaucaaugcaaagaucuaugccauaugcacacuggagugguggucgaaaagaagaaaagagggggcaaagaggagaucaccccgcacugugcuuuaauggacugcauaauguaugaugcagcugugucaggaggacucaauauaccaguuuuaagagcaguucuccccagggacaugguguuuagaacuucaagccccaaggucguccuguaa

SEQ ID NO: 707 - RNA, 1710 nt, Artificial Sequence
  derived and/or modified CDS sequence (wt) from Lassa virus__AIT17659__NP
augagugcuucuaaggaagugaagucauuucucuggacacagucauugaggagggagcucucagguuauugcuccagcauaaagcuucaaguuguuaaggaugcucaggcucuccuucauggucuugacuuuuccgaagucagcaaugugcagcgcuuaaugcgcaaacaaaaaagagaugauagugauuugaaacgccucagagaucugaaucaggcugucaacaaucuuguagaacucaagucaacacaacaaaagagugucuugagaguugggaccuugaccucagacgaccugcugacauuggcagccgacuuagagaaauugaaaucgaaagucauaagaacagaaaggccacuuagcucagguguuuauauggggaacuugaguacacaacagcuugagcaaagaagagcauuacuaagcaugauaggcaugguugguggggcucagggcacccaaccugggagagauggaguuguuagggugugggauguuaagaauccggaucuuuugaacaaucaguuuggcaccaugccuagucugacauuagcaugucucacuaaacaaggucaaguugauuugaaugaugccgucuuagcacuaacagaccugggucuaauauauacagcuaaguacccaaauagcuccgaucuagacagacuuucccaaagccacccuauacugaauaugguggacaccaagaagagcuccuugaacauuucugguuacaacuucagcuuaggagcugcagugaaagcuggagcuuguaugcuagaugggggaaacauguuggagaccaucaaggucacaccucagacaauggauggcaucuugaagucaauuuuaaagguaaaaagaucuuugggaauguuuguuucagauacaccuggugaaaggaacccuuaugagaauauacuuuacaagaucugucuuucuggugacgguuggcccuauauagcuucaaggacuucuauuguggguagggcuugggagaauacuacuguggaucuugagucagaugggaaaccacaaaaggugggcacugcuggguccaacaagucuuuacagucagcgggguuuccaacagggcugaccuauucucaguugaugacacuuaaagacucaaugaugcagcuugacccaagugccaaaaccuggauagacauugaaggucguccagaagacccuguggaaauagcucuuuaccaaccuaugucgggcuguuacauacacuucuucagagaaccaacagacuuaaaacaguucaagcaggaugccaaauacucucaugggauugauguagcagaucuuuucccugcucagccugguuugaccagugcagucauugaagcucucccucgcaauaugguacugaccugucaagguucagaugauauuaagagacucuuggacucccaaggaaggagggacauaaagcucauagacauugcacugaacaaggcugacuccaggagauuugagaaugcuguuugggaucagugcaaagaucuaugccauaugcacacuggagugguugucgaaaagaagaaaagaggagggaaagaagagaucaccccgcacugugcuuuaauggacugcauaauguaugaugcagcugugucaggaggacucaauauaccaguuuuaagagcaguucuccccagagacaugguguucagaacuucaagccccaaggucguccuguaa

SEQ ID NO: 708 - RNA, 1710 nt, Artificial Sequence
  derived and/or modified CDS sequence (wt) from Lassa virus__AIT17663__NP
augagugcuuccaaggaaguaaagucauuccuuuggacacagucauugaggagggagcucucagguuacugcuccagcauaaagcuucaaguuguuaaagaugcucaggcucuccuucauggucuugacuuuucugaagucagcaauguucagcgcuugaugcgcaaacaaaaaagggacgacagugaucugaaacgucucagagaucugaaccaggcugucaacaaucuuguagaacucaaaucaacacaacaaaagaguauccugagaguugggaccuugacuucagaugaccugcugacauuggcagcugacuuagagaaacuuaagucgaaggucaucagaacagaaaggccacuaagcucagguguuuacauggggaauuugaguacacagcaacuugagcaaagaagagcauuguugaacaugauaggcaugguugguggggcucaggguacccaaccuggaagagacggaguuguuagggugugggacgucaagaauccggaucuuuugaacaaccaauucggcaccaugccuagucugacauuagcaugucucaccaaacaaggucaaguugauuuaaaugaugcugucuuagcacuaacagaccuaggucuaauauauacagcuaaguacccaaacagcuccgaccuggacagacuuucccaaagccauccuauacugaauaugguggacacuaagaagagcuccuugaauauuucugguuacaacuucagucuaggagcugcagugaaagcuggagccuguaugcuugauggggggaacauguuggagaccaucaagguuacaccucagacaauggauggcaucuugaaaucuaucuuaaagguaaagagaucuuugggaauguuuguuucagauacaccuggugagaggaacccuuaugagaacauacuuuacaagaucugucuuucuggggacgguuggcccuacauagcuucaagaacuuccauuguggguagagcuugggagaacaccacuguggaucucgagucagauggaaaaccacaaaaggugggcacugcuggguccaacaagucuuuacagucagcgggguuuccaacaggguugaccuauucucaguugaugacacuuaaggacucaaugaugcaacuugacccaagugcuaaaaccuggauagacauugaaggucguccagaagacccuguggaaauagcucuuuaccaaccuaugucgggcuguuauauacacuucuucagagaaccaacagacuugaaacaguucaagcaagaugccaaauauucucauggaauugauguagcagaucuuuucccugcucaaccuggcuugaccagugcagucauugaagcccuuccccgcaauauggugcugaccugucaggguucagacgauauuaagaaacucuuagauucccaaggaagaagggacauaaagcuuauugacauugcacugagcaaagcugacucuaggagguuugagaaugcuguuugggaucaaugcaaggaucuaugccauaugcauacuggggugguuguugaaaagaagaaaaggggaggcaaagaagaaauuaccccgcacugugcucuaauggauugcauuauguaugaugcagcugugucaggaggacucaauauaccaguuuuaagagcaguucuccccagagacaugguguuuagaaccucaagccccaaggucguccuguaa

SEQ ID NO: 709 - RNA, 1710 nt, Artificial Sequence
  derived and/or modified CDS sequence (wt) from Lassa virus__AIT17667__NP
augagugcuuccaaggaagugaagucauuucucuggacacagucauugaggagggagcuuucagguuauugcuccagcauaaagcuucaaguuguuaaagaugcucaagcucuccuucauggucuugacuuuucugaaguuagcaaugugcagcgcuuaaugcgcaaacaaaaaagggaugauagugaucugaaacgucucagagaucugaaucaggcugucaacaaucuuguagaacucaaaucaacacagcaaaagaguaucuugagaguugggaccuugaccucagaugaucugcugacauuggcagcugauuuagagaaacuaaagucgaaggucaucagaacagaaaggccacuaagcucagguguuuauauggggaacuugaguacacagcaacuugagcaaagaagagcauugcugaacaugauaggcaugguugguggggcucagggcacccaaccaggaagagauggaguuguuagggugugggauguuaagaauccagaucuuuuaaacaaccaguucggcaccaugcccagucugacauuagcaugucucacuaaacaaggucagguugauuugaaugaugcugucuuagcacuaacagaccugggucuaauauauacagcuaaguaccccaauagcuccgaccuggacagacuuucccaaagccauccuauauugaauaugguggacacuaagaagagcuccuuaaacauuucugguuacaacuucaguuuaggagcugcagugaaagcuggagcuuguaugcuugauggggggaacauguuggagaccaucaagguuacaccucagacaauagauggcaucuugaagucuauuuuaaagguaaaaaaauccuugggaauguuuguuucagacacaccuggugagaggaacccuuaugagaacauacuuuacaagauuugucuuuccggugacgguuggcccuacauagcuucaaggacuucuauuguggguagagcuugggagaauacuacuguggaucucgagucagauggaaaaccacaaaaagugggaacuaccggguccaacaaaucuuuacagucagcaggguuuccaacagggcugacuuauucucaguugaugacacuuaaagacucaaugaugcagcuugacccaagugccaaaaccuggauagacauugaaggucguccagaagacccuguggaaauugcucuuuaccagccuaugucgggcugcuacauacacuucuucagagaaccaacagacuugaaacaguucaagcaagaugccaaauauucucaugggauugauguaacagaucuuuucccugcucaaccuggauuaaccagcgcagucauugaagcccucccucgcaacaugguacugaccugucaagguucagaagauauuaagcgacucuuagauucccaaggaagaagggacauaaaacucauugacauugcacugagcaaggcugacucuaggagauuugaaaaugcuguuugggaucagugcaaagaccuaugccacaugcacacuggagugguugucgaaaagaagaaaagaggaggcaaagaagaaauuaccccacacugugcucuaauggacugcauaauguaugaugcagcugugucagguggacuuaauauaccaguuuuaagagcaguccuccccagagacaugguguuuagaaccucaagccccaaggucguccuguaa

SEQ ID NO: 710 - RNA, 1710 nt, Artificial Sequence
  derived and/or modified CDS sequence (wt) from Lassa virus__AIT17671__NP
augagugcuuccaaggaagugaagucauuccucuggacacagucauugaggagggagcuuucagguuauugcuccagcauaaagcuucaaguugucaaggaugcucaggcucuccuucauggucucgacuuuucugaaguuagcaaugugcagcgcuuaaugcgcaaacaaaaaagggaugauagugaucugaaacgucucagagaucugaaucaggcugucaacaaucuuguggaacuuaaaucaacacaacaaaagagugucuugagaguugggaccuugaccucagaugaccugcugacauuggcagcugacuuagagaaacuaaagucgaaggucaucagaacagaaaggccacuaagcucagguguuuauauggggaauuugaguacacagcaacuugagcagaggagagcauuacugaacaugauaggcaugguugguggggcucagggcacccaaccuggaagagacggaguuguuagggugugggauguuaaaaauccagaucuuuugaacaaucaguucggcaccaugcccagucugacauuagcaugucucacuaaacaaggccagguugauuugaaugaugucgucuuagcacuaacagaccugggucuaauauacacagcuaaguacccuaauagcuccgaccuggacagacuuucccaaagucauccuauauugaacaugguggacaccaagaagagcuccuugaacauuucugguuacaacuucagcuuaggagcugcagugaaagcuggagcuuguaugcuugaugggggaaacauguuggaaaccaucaagguuacaccucagacaauggauggcaucuugaagucuauuuuaaaggugaaaaaauccuugggaauguuuguuucagacacaccuggugagaggaauccuuaugagaacauacuuuacaagaucugucucucuggugacgguuggcccuacauagcuucaaggacuucaauuguggguagagcuugggagaauacuacuguggaucucgagucagauggaaaaccacaaaaagugggaacugcuggguccaauaagucuuuacagucagcgggguucccaacagggcugacuuacucucaguugaugacacuuaaagacucaaugaugcaacuugacccaagugccaaaaccuggauagacauugaaggucguccagaagacccuguggaaauagcucuuuaccagcccaugucgggcugcuacauacacuucuucagagaaccaacagacuugaaacaguucaagcaagaugccaaauauucucaugggauugauguaacagaucuuuucccugcucaaccuggauuaaccagugcagucauugaagcccucccucgcaauaugguacugaccugucaaggcucagaugacaucaagagacucuuggauucccaaggaagaagggacauaaaacuuauugacauugcauugagcaaggcugacucuaggagauuugaaaaugcuguuugggaucagugcaaagaucuaugccauaugcacacuggagugguugucgaaaagaagaaaagaggaggcaaagaagaaauuaccccacauugugcucuaauggacugcauaauguaugaugcagcugugucaggaggacucaauauaccaguuuuaagagcgguccuccccagagacaugguguuuagaaccucaagccccaaggucguccuguaa

SEQ ID NO: 711 - RNA, 1710 nt, Artificial Sequence
  derived and/or modified CDS sequence (wt) from Lassa virus__AIT17675__NP
augagugcuucuaaggaagugaagucauuucucuggacacagucauugagaagggaacuuucagguuauugcuccagcauaaagcuucaaguuguuaaagaugcucaggcucuccuucauggucuugacuuuucugaagucagcaaugugcagcgcuuaaugcgcaaacaaaaaagggaugauagugaucugaaacgucucagagaucugaaucaggcugucaacaaucuuguggaacucaaaucaacacaacaaaagagugucuugagaguugggaccuuaaccucagaugaccugcugacauuggcagcugacuuagagaaacuaaagucaaaggucauuagaacagaaagaccacugagcucagguguuuauauggggaauuugaguacacagcagcuugagcaaaggagagcauuguugaacaugauaggcaugguugguggggcucagggcacccaaccuggaagagacggagugguuagggugugggauguuaaaaauccggaucuuuugaacaaccaguuuggcaccaugccuagucugacauuagcaugucucacuaaacaaggucaaguugauuugaaugaugccgucuuagcacuaacagaccugggucuaauauauacagcuaaguacccaaauagcuccgaccuggacagacuuucucaaagucauccuauacugaacaugguggacacuaagaaaagcuccuugaacauuucugguuacaacuucagcuuaggagcugcagugaaagcuggagcuuguaugcuugauggggggaacauguuggagaccaucaagguuacaccucagacaauggauggcauccugaagucuauuuuaaagguaaaaaaauccuugggaauguuuguuucagauacaccuggugagaggaacccuuaugagaacauacuuuacaagaucugucuuuccggugacggcuggcccuacauagcuucuaggacuuccauugugggcagagcuugggagaauaccaucguggaucucgagucagaugggaaaccacaaaaggugggcacugcugggucuaacaagucuuuacagucagcgggguuuccaacagggcugaccuauucucaguugaugacacuuaaagacucaaugaugcagcuugacccaagugccaaaaccuggauagacauugaaggucguccagaggacccuguagaaauagcucuuuaccaaccuaugucgggcuguuauauacauuucuucagagagccaacagacuuaaaacaguucaaacaagaugccaaauauucucaugggauugauguagcagaucuuuucccugcucaaccuggcuugaccagugcagucauugaagcccucccccgcaauaugguccugaccugucaagguucagaugacauuaagagacucuuggauucucaagggagaagggacauaaagcuuauugacauugcacugagcaaggcugacucuaggagauuugaaaaugcuguuugggaucagugcaaagaucuaugccauaugcacacuggaguggucgucgaaaagaagaaaagagggggcaaagaagaaauuaccccgcauugugcuuuaauggacugcauaauguaugaugcagcugugucaggaggacucaauauaccaguuuuaagagcaguucuccccagagauaugguguuuagaaccucaagccccaaagucguccuguaa

SEQ ID NO: 712 - RNA, 1710 nt, Artificial Sequence
  derived and/or modified CDS sequence (wt) from Lassa virus__AIT17679__NP
augagugcuuccaaggaagugaagucauuucucuggacacagucauugaggagggagcuuucagguuacugcuccagcauaaaacuucaaguuguuaaggaugcucaggcucuccuucauggucuugacuuuucugaagucagcaaugugcagcgcuuaaugcgcaaacaaaagagggaugauagcgaucugaaacgucucagagauuugaaucaggcugucaacaaucuuguagaacucaaaucgacacaacaaaagagcaucuugagaguugggacuuugaccucagaugaccugcugacauuggcagccgacuuagaaaaacuaaagucgaaggucauuagaacagaaaggccacuaagcucagguguuuauauggggaauuugaguacacagcaacuugagcaaagaagagcauugcugaacaugauaggcaugguugguggggcucagagcacccaaccuggaagagacggaguugucagggugugggauguuaagaacccagaucuuuugaacaaucaguucggcaccaugccuagucugacauuagcaugucuuaccaaacaaggucagguugauuugaaugaugcugucuuagcacuaacagaccugggucuaauauacacagcuaaguauccaaauagcuccgaccuggacagacuuucccaaagccaucccauacugaauaugguggacacuaagaagaguuccuugaacauuucugguuacaacuucagcuuaggagcugcagugaaagcuggagcuugcaugcuugauggggggaacauguuggagaccauuaagguuacaccucagacaauggauggcaucuugaagucuauuuuaaagguaaaaagaucuuugggaauguuuguuucagauacaccuggugagaggaacccuuacgagaacauacuuuacaagaucugucuuuccggugacggcuggcccuacauagcuucaaggacuucuauuguggguagagcuugggagaauacaaccguggaucuugagucagauggaaagccacaaaaagugggcacugcuggguccaacaagucuuuacagucagcaggguuuccaacagggcugaccuauucucaguugaugacacuuaaagacucaaugaugcagcuugacccaagugccaaaaccuggauagauauugaaggucguccagaagacccuguggaaaucgcucuuuaccaaccuaugucgggcuguuacauacacuucuucagagaaccaacagauuuaaaacaguucaagcaagaugccaaauauucucacgggauugauguggcagaucuuuucccugcucaaccugguuugaccagugcagucauugaggcccucccucgcaauaugguacugaccugucaagguucagaugauauuaagagacucuuggacucccaaggaagaagggacauaaagcuuauugacauugcacugagcaaggcugauucuaggagauuugaaaaugcuguuugggaucagugcaaagaucuaugccauaugcauacuggagugguuguugaaaagaagaaaagaggagguaaagaggaaauuaccccacacugugcuuuaauggacugcauaauguaugacgcagcugugucaggaggacucaauauaccaguuuuaagagcaguucuccccagagacaugguguuuagaaccucaagccccaaggucguccuguaa

SEQ ID NO: 713 - RNA, 1710 nt, Artificial Sequence
  derived and/or modified CDS sequence (wt) from Lassa virus__AIT17683__NP
augagugcuucuaaggaagugaagucauuucucuggacacagucuuugaggagggagcuuucagguuauugcuccaauauaaaacuucaaguuguuaaggaugcucaggcucuccuucauggucuugacuuuucugaagucagcaaugugcagcgcuuaaugcgcaaacaaaagagggaugauagugaucugaaacgucucagagauuugaaucaggcugucaacaaucuuguagaacuuaaaucgacacaacaaaagaguaucuugagaguugggaccuugaccucagaugaccugcugacauuagcagcugacuuagagaaacuaaagucgaaggucauuagaacggagaggccacuaagcucagguguuuauauggggaauuugaguacacagcagcuugagcagagaagagcauugcugaacaugauaggcaugguugguggggcucaaggcacccaaccuggaagagacggaguuguuagggugugggauguuaagaauccggaccuuuugaacaaccaguucggcaccaugccuagucugacauuggcaugucucaccaaacaaggucaaguugauuugaaugaugccgucuuagcacugacagaccugggucuaauauacacagccaaguacccaaauagcuccgaccuagacagacuuucccaaagccauccuauacugaauaugguggacacuaagaaaagcuccuugaacauuucugguuucaacuucagcuuaggagcugcagugaaagcuggagcuuguaugcuugauggggggaacauguuggagaccaucaagguuacaccucagacaauggauggcaucuuaaagucuaucuuaaagguaaaaaagucuuugggaauguuuguuucggacacaccuggugagaggaacccuuaugagaauauacuuuacaagaucugucuuuccggugacggauggccuuacauagcuucaaggacuucuauuguggguagggcuugggaaaauaccacuguggaucucgagucagauggaaaaccgcaaaaagugggcacugcuggguccaacaagucuuuacagucagcgggguucccaacagggcugacuuauucucaguugaugacacuuaaagacucaaugaugcagcuugacccaagugccaaaaccuggauagacauugaaggucguccagaagacccuguggaaauagcucuuuaccaaccuaugucaggcuguuacauacacuucuucagagaaccaacagacuuaaagcaguucaagcaagaugccaaauauucucaugggauugauguggcagaucuuuucccugcucaaccugguuugaccagugcagucauugaagcccuuccucgcaauauggugcuaaccugucaagguucagaugauauuaagagacucuuagacucccaaggaagaagggauauaaagcuuauugacauugcacugagcaaggcugacucuaggagauuugaaaaugcuguuugggaucagugcaaagaucuaugccauaugcacaccggagugguugucgaaaagaagaaaagaggaggcaaagaagaaauuaccccgcacugugcuuuaauggacugcauaauguaugaugcagcugugucaggaggacucaacauaccaguuuuaagggcaguucuccccagggacaugguguuuagaaccucaagucccaaggucguccuguaa

SEQ ID NO: 714 - RNA, 1710 nt, Artificial Sequence
  derived and/or modified CDS sequence (wt) from Lassa virus__AIT17687__NP
augagugcuucuaaggaagugaagucauuucuuuggacacagucauugaggagggagcuuucagguuauugcuccaguauaaaacuucaaguuguuaaagaugcucaggcucuccuucauggucuugauuuuucugaagugagcaaugugcagcgcuuaaugcgcaaacaaaaaagagaugauagugauuugaaacgucucagagaccugaaccaggcuguuaacaaucucguagaacucaaaucgacgcaacaaaagagcaucuugagaguugggaccuugaccucagaugaccugcugacauuggcagcugacuuggagaaacugaagucgaaggucauuagaacagaaaggccacuaagcucagguguuuauauggggaauuugagugcacaacagcuugagcagagaagagcauugcugaacaugauaggcaugguuggcggggcucagggcacccaaccuggaagagacgggguuguuagggugugggauguuaagaauccggaucuuuugaacaaccaguuuggcaccaugccuagucugacauuagcaugucucaccaaacaaggucaaguugauuugaaugaugccgucuuagcacuaacagaccugggucugauauacacagcuaaguauccaaauagcuccgaccuggacagacuuucccaaagccauccuauacugaacaugguggacacuaagaagagcuccuugaacauuucugguuacaacuucagcuuaggagcugcagugaaagcuggagcuuguaugcuugauggggggaacauguuggagaccaucaagguuacaccucagacaauggauggcaucuugaaaucuaucuuaaagguaaaaagaucuuugggaauguuuguuucagauacaccuggugagaggaacccuuaugaaaacauacuuuacaagaucugucuuuccggugacggcuggcccuacauagcuuccaggacuucuauuguggguagagcuugggagaauacuacuguagaucucgagucagaugggaaaccacaaaaaguggguacugcuggguccaacaagucuuuacagucagcgggguucccaacagggcugaccuauucucaguugaugacgcucaaagacucaaugaugcagcuugacccaagugccaaaaccuggauagacauugaaggccguccagaagaccccguggaaauagcucuuuaccaaccuaugucaggcuguuacauacacuucuuuagagaaccaacagacuuaaagcaguucaagcaagaugcuaaguacucucaugggauugauguggcagaucuuuucccugcucaaccugguuugaccagugcagucauugaagcccucccucgcaauauggugcugaccugccaagguucagaugauauuaagaggcuuuuagacucccaaggaagaagggacauaaagcuuauugacauugcacugagcaaagcugacucuaggagauuugaaaaugcuguuugggaucagugcaaagaucugugccauaugcauacuggagugguugucgaaaagaagaagagaggaggcaaagaagaaauuaccccgcacugugcuuuaauggacugcaucauguaugaugcagcugugucuggaggacucaauauaccaguuuuaagagcgguucuccccagagacaugguguuuagaaccucaagccccaaggucguccuguaa

SEQ ID NO: 715 - RNA, 1710 nt, Artificial Sequence
  derived and/or modified CDS sequence (wt) from Lassa virus__AIT17695__NP
augagugcuucuaaggaagugaagucauuucucuggacacagucauugaggagggagcuuucagguuauugcuccaacauaaaacuucaaguuguuaaggaugcucaggcucuccuucauggucuugacuuuucugaagucagcaaugugcagcgcuuaaugcgcaaacaaaagagggaugauagugaucugaaacgucucagagauuugaaucaggcugucaacaaccuuguagaacuuaaaucgacacaacaaaagaguaucuugagaguugggaccuugaccucagaugaccugcugacauuggcagcugacuuggagaaacuaaagucgaaggucauuagaacagaaaggccacuaagcucagguguuuauauggggaauuugaguacacagcagcuugagcagagaagagcauugcugaacuugauaggcaugguugguggggcucagggcacccaaccuggaagagacggaguuguuaggguuugggauguuaagaauccggaccuuuugaacaaccaguucggcaccaugccuagucugacauuggcaugucucaccaaacaaggucaaguugauuugaaugaugucgucuuagcacugacagaccugggccuaauauacacagccaaauacccaaauagcuccgaccuggacagacuuucucaaagccauccuauacugaauaugguggacacuaagaagagcuccuugaacauuucugguuucaacuucagcuuaggagcugcagugaaagcuggagcuuguaugcuugauggggggaacauguuggagaccaucaagguuacaccucacacaauggauggcaucuugaagucuauuuuaaagguaaaaaaaucucugggaauguuuguuucggacacaccuggugagaggaacccuuaugagaauauacuuuacaagaucugucuuuccggugacggauggccuuacauagcuucaaggacuucuauuguggguagggcuugggagaauaccacuguggaucucgagucagauggaaaaccgcauaaagugggcacugcuggguccaacaagucuuuacagucagcaggguucccaacagggcugacuuauucucaguugaugacacuuaaagacucaaugaugcagcuugacccaagugccaaaaccuggauagauauugaaggucguccagaagacccuguggagauagcccuuuaccaaccuaugucaggcuguuacauacacuucuucagagaaccaacagacuugaaacaguucaagcaagaugccaaauauucucaugggauugauguggcagaucuuuucccugcucaaccugguuugaccagugcagucauugaagcccucccucgcaauaugguguuaaccugucaagguucagaugauauuaagagacucuuagacucccaaggaagaagggauauaaagcuuauugacauugcacugagcaaggcugacucuaggagauuugagaaugcuguuugggaucagugcaaagaucuaugccauaugcacacuggagugguugucgaaaagaagaaaagaggaggcaaagaagaaaucaccccgcacugugcuuuaauggacugcauaauguaugaugcagcugugucaggaggacucaauauaccaguuuuaagggcaguucuccccagggacaugguguuuagaaccucaagucccaaggucguccuguaa

SEQ ID NO: 716 - RNA, 1710 nt, Artificial Sequence
  derived and/or modified CDS sequence (wt) from Lassa virus__AIT17705__NP
augagugcuucuaaggaagugaagucauuucucuggacacagucuuugaggagggagcuuucagguuauugcuccaauauuaaacuucaaguuguuaaggaugcucaggcucuccuucauggucuugacuuuucugaagucagcaaugugcaacgcuuaaugcgcaaacaaaagagggaugauagugaucugaaacgucuccgagauuugaaucaagcugucaacaaucuuguagaacuuaaaucgacacaacaaaagaguaucuugagaguugggaccuugaccucagaugaccugcugacauuggcagcugacuuagagaaacuaaagucgaaggucauuagaacagaaaggccacuaagcucagguguuuauaugggaaauuugaguacacagcaacuugagcagagaagagcauugcugaacuugauaggcaugguugguggggcucagggcacccaaccuggaagagacggaguuguuaggguuugggauguuaagaauccggaccuuuugaacaaccaguucggcaccaugccuagucugacauuggcaugucucaccaaacagggucaaguugauuugaaugaugccgucuuagcacugacagaccugggccuaauauacacagccaaguacccaaauagcuccgaccuggacagacuuucccaaagccauccuauacugaauaugguggacacuaagaagagcuccuugaacauuucugguuucaacuucagcuuaggagcugcagugaaagcuggagcuuguaugcuugauggggggaacauguuggagaccaucaagguuacaccucagacaauggauggcaucuugaagucuauuuuaaagguaaaaaaaucuuugggaauguuuguuucggacacaccuggugagaggaacccuuaugagaauauacuuuacaagaucugucuuuccggugacggauggcccuacauagcuucaaggacuucuauuguggguagggcuugggagaauaccacuguggaucucgagucagauggaaaaccgcacaaagugggcacugcuggguccaacaggucuuuacaaucagcgggguucccaacagggcugacuuauucucaauugaugacacuuaaagauucaaugaugcagcuugacccaagugccaaaaccuggauagauauugaaggucguccagaagacccuguggagauagcccuuuaccaaccuaugucaggcuguuacauacacuucuucagagaaccaacagacuugaaacaguucaagcaagaugccaaauauucucaugggauugauguggcagaucuuuucccugcucaaccugguuugaccagcgcagucauugaagcccucccucgcaauauggugcuaaccugucaagguucagaugauauuaagagacucuuagacucccaaggaagaagggauauaaagcuuauugacauugcacugagcaaggcugacucuaggagauucgaaaaugcuguuugggaucagugcaaagaucuaugccauaugcacacuggagugguugucgaaaagaagaaaagaggaggcaaagaagaaaucaccccgcacugugcuuuaauggacuguauaauguaugaugcagcugugucaggaggacucaauauaccaguuuuaagggcaguucuccccagggacaugguguuuagaaccucaagucccaaggucguccuguaa

SEQ ID NO: 717 - RNA, 1710 nt, Artificial Sequence
  derived and/or modified CDS sequence (wt) from Lassa virus__AIT17711__NP
augagugcuucuaaggaagugaagucauuucucuggacacagucuuugaggagggagcuuucagguuauugcuccaauauaaaacuucaaguuguuaaggaugcucaggcucuccuucauggucuugacuuuucugaagucagcaaugugcagcgcuuaaugcgcaaacaaaagagggaugauagugaucugaaacgucucagagauuugaaucaggcugucaacaaucuuguagaacucaaaucgacacagcaaaagaguaucuugagaguugggaccuugaccucagaugaccugcugacauuggcagcugacuuagagaaacuaaagucgaaggucauuagaacagaaaggccacuaagcucagguguuuauauggggaauuugaguacacagcagcuugagcagaggagagcauugcugaacuugauaggcaugguugguggggcucagggcacccaaccuggaagagacggaguuguuaggguuugggauguuaagaauccggaccuuuugaacaaccaguucggcaccaugccuagucugacauuggcaugucucaccaaacaaggucaaguugauuugaaugaugccgucuuagcacugacagaccugggccuaauauacacagccaaguacccaaauagcuccgaccuggacagacuuucccaaagccauccuauacugaauaugguggacacuaagaagagcuccuugaacauuucugguuucaacuucagcuuaggagcugcagugaaagcuggagccuguaugcuugauggggggaacauguuggagaccaucaagguuacaccucagacaauggauggcaucuugaagucuauuuuaaagguaaaaaaaucuuugggaauguuuguuucggacacaccuggugagaggaacccuuaugagaauauacuuuacaagaucugucuuuccggugacggauggcccuacauagcuucaaggacuucuauuguggguagggcuugggagaauaccacuguggaucucgagucagauggaaaaccgcauaaagugggcacugcuggguccagcaagucuuugcagucagcgggguucccaacagggcugacuuauucucaguugaugacacuuaaagacucaaugaugcagcuugacccaagugccaaaaccuggauagacauugaaggucguccagaagacccuguggagauagcccuuuaccaaccuaugucaggcuguuacauacacuucuucagagaaccaacagacuugaaacaguucaagcaagaugccaaauauucucaugggauugauguggcagaucuuuucccugcucaaccugguuugaccagcgcagucauugaagcccucccucgcaauauggugcuaaccugucaagguucagaugauauuaagagacucuuagacucccaaggaaggagggauauaaagcuuauugacauugcacugagcaaggcugacucuaggagauuugaaaaugcuguuugggaucaguguaaagaucuaugccauaugcacacuggaguaguugucgaaaagaagaaaagaggaggcaaagaagaaaucaccccgcacugugcuuuaauggacugcauaauguaugaugcagcugugucaggaggacucaauauaccaguuuuaagggcaguucuccccagggauaugguguuuagaaccucaagucccaaggucguccuguaa

SEQ ID NO: 718 - RNA, 1710 nt, Artificial Sequence
  derived and/or modified CDS sequence (wt) from Lassa virus__AIT17713__NP
augagugcuucuaaggaagugaagucauuccucuggacacagucauugaggagagaacuuucagguuauugcuccaacauaaaacuucaaguuguuaaggaugcucaggcucuccuucauggucuugacuuuucugaagucagcaaugugcagcgcuuaaugcgcaaacaaaaaagggaugauagugaucugaagcgucucagagauuugaaucaggcugucaacaaucuuguagaacucaaaucgacacaacaaaagaguaucuugaggguugggacuuugaccucagaugaccugcugacauuagcagcugacuuagagaaacuaaagucgaaggucauuagaacagaaaggccauuaagcucaggugucuauauggggaauuugaguacacagcagcuugagcagagaagagcauugcugaacaugauagguaugguugguggggcucagggcacccaaccuggaagagacggaguuguuagggugugggauguuaagaauccggaucuuuugaacaaccaguuuggcaccaugccuagucugacauuagcaugucucacuaaacaaggucaagucgauuugaaugacgccgucuuggcacuaacagaccugggucuaauauacacagcuaaguacccaaauagcuccgaccuggacagacuuucccaaagccacccuauacugaauaugguggacauuaagaagagcuccuugaacauuucugguuacaacuucagcuuaggagcugcaguaaaagcuggagcuuguaugcuugauggggggaacauguuggagaccaucaagguuacaccucagacaauggauggcauccugaagucuauuuuaaagguaaaaaagucuuugggaauguuuguuucagauacgccuggugagaggaacccuuaugagaacauacuuuacaagaucugucuguccggugacggcuggcccuacauagcuucaaggaccucuauuguggguagagcuugggagaacacuacuguggaucucgagucagauggaaaaccgcaaaaagugggcacugcuggguccaacaaguccuuacagucagcgggguucccaacagggcugaccuauucccaguuaaugacacuuaaagacucaaugaugcagcuugacccaagugccaaaaccuggauagauauugaaggucguccagaagacccuguggagauagcucucuaccaaccuaugucgggcuguuacauacacuucuucagagaaccaacagacuuaaaacaguucaagcaggaugccaaauauucucaugggauugauguggcagaccuuuucccugcucaaccugguuugaccagcgcagucauugaagcccucccucgcaauaugguacugaccugucaagguucagaugauaucaagagacucuuggacucccaaggaagaagggacauaaaacuuauugacauugcacuaaacaaggcugacucuaggagauuugaaaaugcuguuugggaucagugcaaagaucuaugccauaugcacacuggagugguugucgaaaagaagaaaagaggaggcaaagaagaaauuaccccgcacugugcuuuaauggacuguauaauguaugaugcagcugugucaggaggacucaauauaccaguuuuaagagcaguucuccccagggacaugguguuuagaaccucaagccccaaggucguccuguaa

SEQ ID NO: 719 - RNA, 1710 nt, Artificial Sequence
  derived and/or modified CDS sequence (wt) from Lassa virus__AIT17719__NP
augagugcuucuaaggaagugaagucauuucucuggacacagucauuaaggagggagcuuucagguuacugcuccagcauaaagcuucaaguuguuaaggaugcucaggcucuccuucauggucuugacuuuucugaagucagcaaugugcagcgcuuaaugcgcaaacaaaaaagggaugauagugaucugaagcgucuuagagaucugaaucaggcugucaacaaucuuguagaacucaaaucaacacaacaaaagaguaucuugagaguugggaccuugaccucagaugaccugcugacauuagcagcugacuuagagaaacuaaagucgaagguaaucagaacagaaaggccacuaagcucagguguuuauauggggaacuuaaguacgcaacagcuugagcaaagaagagcauugcugaacaugauaggcaugguuaguggagcucaaggcacccaaccuggaagagacggaguuguuagggugugggauguuaagaauccggaacuuuugaacaaccaguucggcaccaugccaagucugacauuggcaugccucaccaaacaaggucaaguugauuugaaugaugcugucuuagcacuaacagacuugggucuaauauacacagcuaaguacccaaauagcuccgaccuggacagacuuucucaaagccauccuauacugaauaugguggacacuaagaagagcucauugaacauuucugguuacaacuucagcuuaggagcugcaguaaaagcuggagcuuguaugcuugauggggggaacauguuggagaccaucaagguuacaccccagacaauggauggcaucuugaaguccauuuuaaaggugaaaaaauccuuaggaauguuuguuucagauacaccuggugagaggaacccuuaugaaaacauacuuuacaagaucugucuuuccggugacggcuggcccuacauagcuucaaggacuucuauuguggguagagcuugggagaauacuacuguggaucuugagucagauggaaaaccacaaaaagugggcacugcuggguccaacaagucuuuacaaucagcgggguuuccaacagggcugaccuauucucaguugaugacacuuaaagauucaaugaugcagcuugacccaagugccaaaacuuggauagacauugaaggucguccagaagacccuguggaaauagcucuuuaccaaccuaugucgggcuguuacauacacuuuuucagagaaccaacagacuuaaaacaguucaaacaagaugccaaauauucucaugggauugauguagcagaucuuuucccugcucaaccuggcuugaccagugcagucauugaggcccucccucgcaauaugguacugaccugucaagguucagaugauauuaagagacuccuggacucccagggaagaagagacauaaagcuuauugacauuucacugagcaaggcugacuccaggagauuugaaaaugcuguuugggaucagugcaaagaucuaugccauaugcauacuggagugguugucgaaaagaagaaaagaggaggcaaagaagaaaucaccccgcacugugcuuuaauggacugcauaauguaugaugcagcugugucaggaggacucaauauaccaguuuuaagagcaguucuccccagagacaugguguuuagaaccucaagccccaaggucguccuguaa

SEQ ID NO: 720 - RNA, 1710 nt, Artificial Sequence
  derived and/or modified CDS sequence (wt) from Lassa virus__AIT17725__NP
augagugcuucuaaggaaguaaagucauuucucuggacacagucauugaggagagagcuuucagguuacuguuccaacauaaaacuucaaguuguuaaggaugcucaggcucuccuucauggucuugacuuuucugaagucagcaaugugcagcgcuuaaugcgcaaacaaaaaagggaugacagugaucugaaacgucucagagauuugaaucaggcugucaacaaucuuguagagcucaaaucgacacaacaaaagagcaucuugagaguugggaccuugaccucagaugaccugcugacauuggcagcugacuuagagaaacuaaagucgaaggucaucagaacagaaaggccacuaagcucagguguuuauauggggaauuugagugcacagcaacuugagcagagaagagcauugcugaacaugauaggcaugguugguggggcucagggcacccaacuuggaagagacggaguuguuagggugugggauguuaagaauccggaucuuuugaacaaucaguucggcaccaugccuagucugacauuggcaugucucaccaaacaaggucaaguugauuugaaugaugccgucuuagcacuaacagaccuggguuuaauauacacagcuaaauacccaaauagcuccgaccuggacagacuuucccaaagccauccuauacugaauaugguggacacuaagaagagcucucugaacauuucugguuacaacuucagcuuaggagcugcagugaaagcuggagcuuguaugcuugauggggggaauauguuggagaccaucaagguuacaccucaaacaauggauggcaucuugaaguccauuuuaaagguaaagaaaucuuugggaauguuuguuucagauacaccuggugagaggaacccuuaugagaacauacuuuacaagaucugucuuuccggugacggcuggcccuacauagcuucaaggacuucuauuguggguagagcuugggagaauacuacuguggaucucgagucagauggaaaaccgcaaaaaguggguacugcuggguccaacaagucuuuacagucagcgggguucccaacagggcugaccuauucucaguuaaugacacuuaaagacucaaugaugcagcuugacccaagugccaaaaccuggauagacauugaaggucguccagaagacccuguggaaauagcucuuuaccaaccuaugucgggcuguuauauacacuuuuuuagagaaccaacagacuugaaacaguucaagcaagaugccaaguauucucaugggauugauguggcagaucuuuucccugcucaaccugguuugaccagugcaguuauugaagcccucccucgcaauaugguacugaccugucaagguucagaggauauuaagagacucuuggacucccaaggaagaagggacauaaagcuuauugacauugcacugagcaaggcugacucuaggagauuugaaaaugcuguuugggaucagugcaaagaucuaugccauaugcauacuggagugguugucgagaagaagaaaagaggaggcaaagaagaaauuaccccgcacugugcuuugauggacugcauaauguaugaugcagcuguaucaggaggacucaauauaccaguuuuaagagcaguucuccccagggacaugguguuuagaaccucaagccccaaggucguccuguaa

SEQ ID NO: 721 - RNA, 1710 nt, Artificial Sequence
  derived and/or modified CDS sequence (wt) from Lassa virus__AIT17729__NP
augagugcuucuaaggaagugaagucauuucucuggacacagucauugaggagggagcuuucagguuauugcuccagcauaaaacuucagguuguuaaggaugcucaggcucuccuccauggucuugacuuuucugaagucagcaaugugcagcguuuaaugcgcaaacaaaggagggaugauagugaucugaagcgucuuagagauuugaaucaggcugucaacaaucuuguugaacucaaaucaacacaacaaaagagcaucuugagaguugggaccuugaccucagaugaccugcugacauuggcagcugacuuagagaaacuaaagucgaaagucauuagaacagaaaggccacuaagcucagguguuuauauggggaauuugaguacacagcagcuugagcaaaggagagcacugcugaacaugauaggcaugguugguggaacucagggcacccaaccuggaagagacggaguuguuaggguaugggauguuaagaauccggaucuuuugaacaaucaguucggcaccaugccuagucugacacuggcaugucucaccaaacaaggucaaguugacuugaaugaugccgucuuagcacuaacagacuugggucugauauacacagccaaguauccaaauagcucugaccuggacagacuuucccaaagccacccuauacugaauaugguggacacuaagaagagcuccuugaacauuucugguuacaacuucagcuuaggagcugcagugaaagcuggagcuuguaugcuugauggggggaacauguuggagaccaucaaggucacaccucagacaauggauggcaucuugaagucaauuuuaaaggugaaaagaucuuugggaauguuuguuucagauacaccuggugagaggaacccuuacgagaauauacuuuacaaaaucugucuuucuggugacggcuggcccuacauagcuucaaggacuucuauuguggguagagcuugggaaaauacuacuguggaucucgagucagauggaaaaccacagaaaguggguacugcuggguccaacaaaucuuuacaaucagcgggguuuccaacagggcugaccuauucucaguugaugacacuuaaagacucaaugaugcagcuugacccaagugccaaaaccuggauagacauugaaggucguccagaagacccuguggaaauagcucuuuaccaaccuaugucgggcuguuacauacacuucuuuagagaaccaacagauuuaaaacaguucaagcaagaugccaaauauucucaugggauugauguggcagaucuuuucccugcucaaccugguuugaccagugcagucauugaagcucucccucgcaauaugguacugacuugucaagguucagaugauauuaagagacucuuggacucccaaggaagaagggacauaaagcuuauugacauugcacugagcaaggcugacucuaggaaauuugaaaaugcuguuugggaucaguguaaagaucuaugccauaugcauacuggagugguugucgaaaagaagaaaagaggaggcaaagaagaaauuaccccgcauugugcuuuaauggacugcauaauguaugaugcagcugugucaggaggacucaauauaccaguuuuaagagcaguucuccccagagacaugguguuuagaaccucaagccccaaggucguccuguaa

SEQ ID NO: 722 - RNA, 1710 nt, Artificial Sequence
  derived and/or modified CDS sequence (wt) from Lassa virus__AIT17733__NP
augagugcuuccaaggaagugaagucauuucucuggacacagucauugaggagggagcucucagguuauugcuccaacauaaaacuucaaguuguuaaggaugcucaagcucuccuucauggucuugacuuuucugaagucagcaaugugcagcgcuuaaugcgcaaacaaaaaagggacgauagugaucugaaacgucucagagauuugaaucaggcugucaacaaucuuguggaacucaaaucgacacaacaaaagaguaucuugagaguugggaccuugaccucagaugaccugcugauauuggcagcugaccuagagaaacugaagucgaaggucauuagaacagaaaggccacuaagcucagguguuuauauggggaauuugaguacacagcagcuugagcagagaagagcauugcugaacaugauaggcaugguugguggggcucagggcacccaaccuggaagagacgggguuguuagggugugggauguuaaaaauccggaucuuuugaacaaccaguucggcaccaugcccagucugacauuagcaugucucaccaaacaaggucaaguugauuugaaugaugccgucuuagcacuaacagaccugggccuaauauacacagcuaaguacccaaauagcuccgaccuugacagacuuucccaaagccauccuauacugaauaugguggacacuaagaaaagcuccuugaacauuucugguuacaacuucagcuuaggagcugcagugaaagcuggggcuugcaugcuugauggagggaacauguuggagaccaucaagguuacaccucagacaauggauggcaucuugaagucuauuuuaaagguaaaaaaaucuuugggaauguuuguuucagauacaccuggugagaggaaccccuaugagaacauacucuacaagaucugucuuuccggugauggcuggccuuacauagcuucaagaacuucuauuguggguagagcuugggagaauacuacuguggaucucgagucagauggaaaaccgcaaaaagugggcacugcuggguccaacaagucuuuacagucagcgggguucccuacagggcugaccuauucccaguugaugacacuuaaagacucaaugaugcagcuugacccaagugccaaaaccuggauagacauugaaggucguccagaagacccuguggaaauagcucuuuaucaaccuaugucgggcuguuacauacacuucuucagagaaccaacagacuuaaaacaguucaaacaagaugccaaauauucucaugggauugauguggcagaucuuuucccugcucaaccugguuugaccagugcagucauugaagcccucccucgcaauauggugcugaccugucaagguucagaugauauuaagagacucuuggacucccaaggaagaagggacauaaagcuuauugacauugcacugagcaaggcugacuccaggagauuugaaaaugcuguuugggaucagugcaaagaccuaugccauaugcauacuggagugguugucgaaaagaagaaaagaggaggcaaagaagaaauaaccccgcacugugcuuuaauggacuguauaauguaugaugcagcugugucaggaggacucaauauaccgguuuugagagcaguucuccccagggacaugguguuuagaaccucaagccccaaggucguccuguaa

SEQ ID NO: 723 - RNA, 1710 nt, Artificial Sequence
  derived and/or modified CDS sequence (wt) from Lassa virus__AIT17745__NP
augagugcuuccaaggaaauaaagucauuccuuuggacacagucuuugaggagggagcuuucagguuacugcuccagcauaaagcuucaaguuguuaaggaugcucaggcucuccuucauggucuugacuuuucugaagucagcaauguucagcgcuuaaugcgcaaacaaaaaagggacgacagugaucugaaacgucucagagaucugaaccaggcugucaacaaucuuguagaacucaaaucaacacaacaaaagaguauccugagaguugggaccuugaccucagaugaccugcugacauuggcagcggacuuagagaaacuuaagucgaaggucaucagaacagaaaggccacuaaguucagguguuuacaugggaaauuugaguacacagcaacuugagcaaagaagagcauugcugaacaugauaggcaugguugguggggcucaggguacccaaccuggaagggacggaguuguuagggugugggaugucaagaauccggaucuuuugaacaaccaauucggcaccaugccuagucugacauuagcaugucucaccaaacaaggucaaguugauuuaaaugaugccgucuuagcacuaacagaccugggucuaauauacacagcuaaguacccaaacaguuccgaccuggacagacuuucccaaagccauccuauacugaauaugguggacacuaagaagagcuccuugaauauuucugguuacaacuucaguuuaggagcugcagugaaagcuggagccuguaugcuugauggggggaacauguuggagaccaucaagguuacaccucaaacaauggauggcaucuugaaaucuaucuuaaagguaaaaagaucuuugggaauguuuguuucagaugcaccuggugagaggaacccuuaugagaacauacuuuacaagaucugucuuucuggggacgguuggcccuacauagcuucaagaacuuccauuguggguagagcuugggagaacaccacuguggaucucgagucagauggaaaaccacaaaaggugggcacugcuggguccaacaagucuuuacagucagcgggguuuccaacaggguugaccuauucucaguugaugacacucaaagacucaaugaugcaacuugacccaagugcuaaaaccuggauagacauugaaggucguccagaagacccuguggaaauagcucuuuaccaaccuaugucggguuguuacauacacuucuucagagaaccaacagacuugaaacaguucaagcaagaugccaaauauucucaugggauugauguagcagaucuuuucccugcucaaccuggcuugaccagugcaguuauugaggcccuuccucgcaauaugguacugaccugucaggguucagacgauauuaagagacucuuagauucacaaggaagaagggauauaaagcuuauugacauugcacugagcaagguugacucuaggagguuugagaaugcuguuugggaucaaugcaaggaucuaugccauaugcauacuggggugguuguugaaaagaagaaaagaggaggcaaagaagaaauuaccccacacugugcucuaauggauuguauaauguaugaugcagcugugucaggaggacucaauauaccaguuuugagagcaguucuccccagagacaugguguuuagaacaucaagccccaaggucguccuguaa

SEQ ID NO: 724 - RNA, 1710 nt, Artificial Sequence
  derived and/or modified CDS sequence (wt) from Lassa virus__AIT17753__NP
augagugcuucuaaggaagugaagucauuucucuggacacagucauugaggagggagcuuucagguuauugcuccagcauaaaacuucaaguuguuaaggaugcucaggcucuccuucauggucuugauuuuucugaagucagcaaugugcaacgcuuaaugcgcaaacaaaagagggaugacagugaucugaaacgucucagagauuugaaucaggcuguuaacaaucuuguagaacucaaaucgacacaacaaaagagcaucuugagaguugggaccuugaccucagaugaccugcugacauuggcagcugacuuggagaaacuaaagucgaaggucauuagaacggaaaggccacugagcucagguguuuauauggggaauuugaguacacagcagcuugagcaaagaagagcauugcugaacaugauaggcaugguugguggggcucagggcacccaaccugguagagacgguguuguuagagugugggacguuaagaauccggaucuuuugaacaaucaguucggcaccaugccuagucugacauuagcaugucucaccaagcaaggucaaguugauuugaaugaugcugucuuagcacuaacagaccuaggucuaauauacacagcuaaguacccaaauagcuccgaccuggacagacuuucucaaagccaucccauacugaauaugguggacaccaagaagagcuccuugaacauuucugguuacaacuucagcuuaggggcugcagugaaagcuggagcuuguaugcuugaugggggaaacaugcuggagaccauuaagguuacaccccagacaauggauggcaucuugaaaucuauuuuaaagguaaaaagaucucugggaauguuuguuucagauacaccuggcgagaggaacccuuaugagaacauacuuuacaagaucugucuuuccggugacggcuggcccuauauugcuucaaggacuucuauuguggguagagcuugggagaauacuacuguggaucucgagucagauggaaaaccacaaaaaguggguacuacuggguccaacaagucuuuacagucagcaggguuuccaacagggcugaccuauucucaguugaugacacuuaaagacucaaugaugcagcuugacccaagugccaaaacuuggauagacauugaaggucguccagaagacccuguggaaauagcucuuuaccaaccuaugucgggcuguuacauacacuucuucagagaaccaacagauuuaaaacaguucaagcaggaugccaaauauucucaugggauugauguggcagaucuuuucccugcucaaccugguuugaccagugcaguuauugaggcccucccucgcaauauggugcugaccugucaagguucagaugacauuaagagacucuuggacucccaaggaagaagggacauaaagcuuauugacauugcgcugagcaaggcugacucuaggagauuugaaaaugcuguuugggaucagugcaaagaucuaugccauaugcauacuggagugguugucgaaaagaagaaaagaggaggcaaagaggaaauuaccccgcacugugcuuuaauggacugcauaauguaugaugcagcugugucaggaggacucaacauaccaguuuuaagagcaguucuccccagagacaugguauuuagaacuucaagcccaaaggucguccuguaa

SEQ ID NO: 725 - RNA, 1710 nt, Artificial Sequence
  derived and/or modified CDS sequence (wt) from Lassa virus__AIT17763__NP
augagugcuuccaaggaaguaaagucauuucucuggacacagucauugaggagggagcuuucagguuauugcuccagcauaaagcuucaaguuguuaaggaugcucaggcucuccuucauggucuugacuuuucugaagucagcaaugugcagcgcuuaaugcgcaaacaaaaaagggaugauagugaucugaaacgucucagagaucugaaucaggcugucaacaaucuuguagaacucaagucaacacaacaaaagaguaucuugagaguugggaccuugaccucagaugaccugcugacauuggcagcugacuuagagaaacuaaagucgaaggucaucagaacagaaaggccacuaagcucggguguuuauauggggaacuugaguacacagcaacuugagcaaaggagagcauugcugaacaugauagguaugguugguggggcucagggaacccaaccuggaagagacggaguuguuagggugugggauguuaagaauccggaucuuuugaauaaccaguucggcaccaugcccagucugacauuggcaugucucaccaaacagggucaaguugauuugaaugaugcugucuuagcacuaacagaccugggucuaauauacacagcuaaguacccaaauagcuccgaccuagacagacuuucccaaagccauccuauauugaauaugguggacaccaagaagagcuccuugaacauuucugguuacaacuucagcuuaggagcugcagugaaagcuggagccuguaugcuugauggggggaacauguuggagaccaucaagguuacaccucagacaguggaugguaucuugaaguccauucuaaagguaaaaagauccuugggaauguuuguuucagauacaccuggugagaggaacccuuaugagaacauacuuuacaagaucugucuuucuggugacggcuggcccuacauagcuucaaggacuucuauuguggguagagcuugggagaacacuacuguggaucucgagucagaugaaaaaccacaaaaagugggagcugcugggucuaacaagucucuacagucagcgggguuuccaacagggcugacuuauucucaguugaugacacuuaaagacucaaugaugcagcuugacccaagugccaaaaccuggauagacauugaaggucguccagaagacccuguggaaauagcucuuuaccagcccaugucaggauguuacauacacuucuucagagaaccaacagacuuaaaacaguucaagcaagaugccaaguauucucaugggauugaugugacagaucuuuucccugcucaaccuggauuaaccagugcagucauugaagcccuuccucgcaauaugguacugaccugucaagguucagaugauauuaagagacucuuggauucccaaggaagaagggacauaaaacuuauugacauugcacugaguaaggcugacucuaggagauuugaaaaugcuguuugggaucaaugcaaagaucuuugccauaugcacacuggagugguugucgaaaagaagaaaagaggaggcaaggaagaaauuaccccgcacugugcucuaauggacugcauaauguaugaugcagcugugucaggaggacuuaauauaccaguuuuaagagcaguucuccccagagacaugguguuuagaaccucaagccccaaggucguccuguaa

SEQ ID NO: 726 - RNA, 1710 nt, Artificial Sequence
  derived and/or modified CDS sequence (wt) from Lassa virus__AIT17771__NP
augagugcuucuaaggaagugaagucauuucucuggacacagucauugaggagggagcuuucaggcuauugcuccagcauaaaacuucaaguugucaaggaugcucaggcucuccuucauggucuugacuuuucugaagucagcaauguucagcgcuuaaugcguaaacagaaaagggaugauagugaucugaaacgucucagagauuugaaucaggcuguuaacaaucuuguagaacucaaaucgacacaacaaaagagcaucuugagaguugggaccuugaccucagacgaccugcugacauuggcagcugacuuagagaaacuaaagucgaaggucauuagaacagaaagaccacuaagcucagguguuuauauggggaauuugaguacacagcagcuugagcaacgaagagcauugcugaacaugauaggcaugguugguggggcucagggcacccaaccuggaagagacggaguuguuagggugugggauguuaagaauccggaucuuuugaacaaccaguuuggcaccaugccuagucuaacauuagcaugucucaccaaacaaggucaaguugauuugaaugaugccgucuuagcacuaacagaccugggucuaauauacacagcuaaguauccaaauagcuccgaccuagacagacuuucccaaagccauccuauacugaauaugguggacacuaagaagagcuccuugaacauuucugguuacaacuucagcuuaggagcugcagugaaagcuggagcuuguaugcuugauggagggaacauguuggagacuauuaaagucacaccucagacgauggauggcauuuugaagucuauuuuaaagguuaaaagaucuuuaggaauguuuguuucagauacaccuggugagaggaacccuuacgagaacauacuuuacaaaaucugucuuuccggcgacggcuggcccuacauagcuucaaggacuucuauuguggguagagcuugggagaauacuacuguggaucucgagucagauggaaaaacacaaaaagugaguacugcuggguccaacaagucuuuacagucagcaggguuuccaacaggacugacuuauucccaguugaugacacuuaaagacucaaugaugcaacuugacccaagugccaaaaccuggauagacauugaaggucguccagaagacccuguggaaauagcucuuuaccaaccuaugucgggcuguuacauacauuucuucagagaaccaacagauuuaaaacaguuuaagcaagaugccaaauauucucaugggauugaugugacagaucuuuucccugcucaaccugguuugaccagugcggucauugaagcccucccccgcaauaugguacugaccugucaagguucagaugauauuaagagacucuuggacucccaaggaagaagggacauaaagcuuauugacauugcacugaguaaggcugacucuaggagauuugaaaaugcuguuugggaucagugcaaagaucuaugccauaugcauacuggagugguugucgaaaagaagaagagaggaggcaaagaagaaauuaccccgcacugugcuuuaauggacugcauaauguaugaugcagcugugucaggaggacucaauauaccaguuuugagagcaguucuccccagagacaugguguucagaaccucaagccccaaggucguccuguaa

SEQ ID NO: 727 - RNA, 1710 nt, Artificial Sequence
  derived and/or modified CDS sequence (wt) from Lassa virus__AIT17779__NP
augagugcuucuaaggaagugaagucauuucucuggacacagucauugaggagagagcuuucagguuacugcuccaacauaaagcuucaaguuguaaaggaugcucaggcucuccuucauggucuugacuuuucugaaguuagcaaugugcagcgcuugaugcgcaaacaaaagagggaugauggugaucugaaacgucucagagaucugaaucaggcugucaacaaucuuguagaacucaaaucaacacaacaaaagaguaucuugagaguugggacccugaccucagaugaccugcugacauuggcagcugacuuagagaaacuaaagucgaaggucaucagaacagaaaggccacuaagcucagguguuuauauggggaauuugaguacacagcaacuugagcaaagaagggcauugcugaacaugauaggcaugguugguggggcucagggcacccaaccuggaagagacggaguuguuagggugugggauguuaagaauccagaucuuuugaacaaccaguucggcaccaugcccagucugacauuagcaugucuuacuaaacagggucaaguugauuugaaugaugccgucuuagcacuaacagaccugggucuaauauacacagcuaaguacccuaauagcuccgaccuggacagacuuucccaaagccauccuauauugaauaugguggacacuaagaagagcuccuugaacauaucugguuacaacuuuagcuuaggagcugcagugaaagcuggagcuuguaugcuugauggggggaacauguuggagaccaucaagguuacaccucagacaauggauggcaucuugaagucuauuuuaaagguaaaaaaauccuugggaauguuuguuucagauacaccuggugagaggaacccuuaugagaacauacuuuacaagaucugucuuuccggugacggcuggcccuauaucgcuucaaggacuucuauuguggguagagcuugggagaauacuacuguagaucucgagucagauggaaaaccacaaaaggugggaacugcuggguccaacaagucuuuacagucagcgggguuuccaacagggcugacuuauucucaguugaugacacuuaaagauucaaugaugcagcuugacccaagugccaaaaccuggauagacauugaaggucguccagaagacccuguggaaauagcucuuuaccagccuaugucaggcugcuauauacacuucuucagagaaccaacagacuuaaagcaguucaagcaagaugccaaauauucucaugggauugauguaacagaucuuuucucugcucaaccuggauuaaccagugcagucauugaagcccucccucgcaauaugguacugaccugucaagguucagaugauauuaagcgacucuuggauucccaaggaagaagggauauaaagcuuauugacauugcacugagcaagacugacucuaggagauuugaaaaugcuguuugggaucagugcaaagaucuaugccauaugcacacuggaguggucgucgaaaagaagaaaagaggaggcaaagaagaaauuaccccacacugugcucuaauggacugcauaauguaugaugcagcugugucaggaggucucaauauaccaguuuugagagcaguccuccccagggacaugguguuuaggaccucaagccccaaggucguccuguaa

SEQ ID NO: 728 - RNA, 1710 nt, Artificial Sequence
  derived and/or modified CDS sequence (wt) from Lassa virus__AIT17783__NP
augagugcuucuaaggaagugaagucauuucucuggacacagucauugaggagggagcuuucagguuacugcuccaacauaaaacuucaagucguuaaggaugcucaggcucuccuucauggucuugacuucucugaagucagcaaugugcagcgcuuaaugcgcaaacaaaaaagggaugauagugauuugaaacgucucagagauuugaaucaggcugucaacaaucuuguagaacucaaaucgacacaacaaaaaaguaucuugagaguugggaccuugaccucagaugaccugcugacauuagcagcugacuuagagaaauuaaagucgaaggucauuagaacagaaaggccacuaagcucagguguuuauauggggaauuugaguacacagcagcuugagcagagaagagcacugcugaacaugauaggcaugguugguggggcucagggcacccaaccuggaagagacggaguuguuagggugugggauguuaagaauccggaucuuuugaacaaccaguucggcaccaugccuagucugacauuagcaugucucaccaaacaaggucaaguugauuugaaugauguugucuuagcacuaacagaccugggucuaauauacacagcuaaguacccaaauagcuccgaccuggacagacuuucccaaagccauccuauacugaauaugguggacacuaagaagagcuccuugaacauuucugguuacaacuucagcuuaggagcugcaguaaaagcuggagcuuguaugcuugauggggggaacauguuggagaccaucaagguuacaccccagacaauggauggcaucuuaaagucuauuuuaaagguaaaaaaaucuuugggaauguuugucucagacacaccuggugagaggaacccuuaugagaauauacuuuacaagaucugucuuuccggugacggcuggcccuacauagcuucaaggacuucuauuguggguagagcuugggagaacaccacuguggaucucgagucagauggaaagccgcaaaaagugggcacugcuggguccaacaagucuuuacagucagcgggguucccaacagggcugaccuauucucaguuaaugacacuuaaagacucaaugaugcagcuugauccaagugccaaaaccuggauagacauugaaggucguccagaagacccuguggaaauagcucuuuaccaaccugugucgggcuguuacauacacuucuucagagaaccaacagacuuaaaacaguucaagcaagaugccaaauauucucaugggauugauguggcagaucuuuucccugcccaaccugguuugaccagcgcagucauugaagcccucccucgcaauaugguacugaccugucaagguucagaugauauuaagagacucuuggacucccaaggaagaagggacauaaagcuuauugacauugcacugagcaaggcugacuccaggagauuugaaaaugcuguuugggaucagugcaaggaucuaugccauaugcauacuggagugguugucgaaaagaagaaaagaggaggcaaagaagaaaucaccccgcacugugcuuugauggacugcauaauguaugaugcagcugugucaggaggacucaauauaccaguuuuaagagcaguucuccccagggacaugguguuuagaaccucaagccccaaggucguccuguaa

SEQ ID NO: 729 - RNA, 1710 nt, Artificial Sequence
  derived and/or modified CDS sequence (wt) from Lassa virus__AIT17787__NP
augagugcuucuaaggaagugaagucauuccucuggacacagucauugaggagggagcuuucagguuauugcuccaacauaaagcuucaaguuguuaaggaugcucaggcucuccuucauggucuugacuuuucugaaguuagcaaugugcagcgcuugaugcgcaaacaaaagagggaugauggugaucugaaacgucucagagaucugaaucaggcugucaacaaucuuguagaacucaaaucaacacaacaaaagaguaucuugagaguugggaccuugaccucagaugaccugcugacauuggcagcugacuuagagaaacuaaagucgaaggucaucagaacagaaaggccacuaagcucagguguuuacauggggaacuugagcacacagcaacuugagcaaagaagggcauugcugaacaugauaggcaugguugguggggcucagggcacccaaccuggaagagacggaguuguuagggugugggauguuaagaacccagaucucuugaacaaccaguucggcaccaugcccagucugacauuagcaugucucacuaaacagggucagguugauuugaaugaugccgucuuagcacugacagaccugggucuaauauacacagcuaaguacccuaauagcucugaccuggacagacuuucccaaagccauccuauauugaauaugguggacacuaagaagagcuccuugaacaucucugguuacaacuuuagcuuaggagcugcagugaaagcuggagcuuguaugcuugauggggggaacauguuggagaccaucaagguuacaccucagacaauggauggcaucuugaagucuauuuuaaagguaaaaaaauccuugggaauguuuguuucagauacaccuggugagaggaacccuuaugagaacauacuuuacaagaucugucuuuccggugacggcuggcccuacaucgcuucaaggacuucuauuguggguagagcuugggaaaacaccacuguagaucucgagucagauggaaaaccacaaaaagugggaacugcuggguccaacaagucuuuacagucagcgggguuuccaacagggcugacuuauucucaguugaugacacuuaaagacucaaugaugcagcuugacccaagugccaaaaccuggauagacauugaaggucguccagaagacccuguggagauagcucuuuaccagccuaugucgggcugcuauauacacuucuuccgagaaccaacagacuuaaaacaguucaagcaagaugccaaauauucucaugggauugauguaacagaucuuuucucugcucaaccuggauuaaccagugcagucauugaagcucucccucgcaauaugguauugaccugucaagguucagaugauauuaagcgacucuuggauucccaaggaagaagggacauaaagcuuauugauauugcacugagcaagguugacucuaggagauuugaaaaugcuguuugggaucagugcaaagaucuaugccauaugcacacuggaguggucgucgagaagaagaaaagaggaggcaaagaagaaauuaccccacacugugcucuaauggacugcauaauguaugaugcagcugugucaggaggucucaauauaccagucuugagagcaguccucccuagggacaugguguuuagaaccucaagccccaaggucguccuguaa

SEQ ID NO: 730 - RNA, 1710 nt, Artificial Sequence
  derived and/or modified CDS sequence (wt) from Lassa virus__AIT17803__NP
augagugccucaaaggaaauaaaguccuuuuuguggacacagucauugaggagggaauuaucugguuacugcucuaacaucaaauuacagguggugaaagaugcccaagcucuuuuacauggacuugacuucuccgaagucaguaauguucaacggcugaugcgcaaggagagaagggaugacaaugauuugaagcgguugagggaccuaaaucaagcggucaacaaccuuguugaguuaaaaucaacucaacaaaagaguauucugagaguugggacucuaacaucagaugauuuauuaaucuuagccgcugaucuagaaaaguugaaaucaaaggugauuaggacagagaggccauugagugcaggugucuauaugggcaaccugagcucacagcaacuugaccaaagacgagcucuucuaaguaugauaggaaugaguggugguagucaagaggcucgggcagggagagauggaguagugagaguuugggauguaaaaaaugcagaguugcuuaacaaucaguucgggaccaugccaagucugacacuggcaugucugacaaagcaggggcagguugauuugaaugaugcagugcaagcauugacagauuugggucugaucuacacagcaaaguaucccaauacuucagacuuagauaggcugacucaaagucaccccauccuaaacaugauugacaccaagaaaagcucuuugaacaucucagguuauaauuucagccugggugcagcugugaaggcaggagcuugcaugcuggaugguggcaauauguuggagacaaucaaggugucaccucagacaguggacgguauccucaaauccaucuuaaaggucaagaaggcucuugggauguucaucucagacaccccuggugaaaggaauccuuaugaaaacauacucuauaagauuuguuugucaggagauggauggccauauauugcaucaagaacuucaauaacaggaagggcuugggaaaacacugucguugaucuggaaucagauggaaagccacagaaagcugguagcaacaauuccaauaaauccuugcagucggcaggguuuaccgcugggcuuaccuauucucaguuaaugacccugaaggaugcaauguugcaacuugacccaaaugccaagaccuggauggacauugaaggaagaccugaagauccaguggaaauugcccucuaucaaccaaguucaggcugcuacauucacuucuuccgugaaccuacugauuuaaagcaguucaagcaggaugcuaaguacucacaugggauugauguuacagaccucuucgcugcgcaaccgggcuugaccagugcugucauugaugcacucccccgaaauauggucauuaccugucagggguccgaugacauaaggaaacuccuugaaucacaagguaggaaagacaucaaacugauugauauugcccuuagcaaaacugauuccaggaaguaugaaaaugcagucugggaucaguauaaggacuuaugccacaugcacacaggugucguuguugaaaagaagaaaaaaggcgguaaagaggaaauaaccccucacugugcacuaauggacugcaucauguuugaugcagcagugucaggaggacugaacacaucaguuuugagagcagugcugccuagagauaugguguucagaacaucgacaccuagagucgucuuguaa

SEQ ID NO: 731 - RNA, 1710 nt, Artificial Sequence
  derived and/or modified CDS sequence (wt) from Lassa virus__AIT17811__NP
augagugccucaaaggaaauaaaauccuuuuuguggacacaauccuugaggagggaauuaucugguuacugcuccaacaucaaacuacagguggugaaagaugcccaggcccuuuuacauggacuugacuucucugaagucaguaauguucaacgguugaugcgcaaggagagaagggaugacaaugauuugaaacgguugagggaucuaaaucaagcggucaacaaucuuguugaauuaaagucaacucaacaaaagaguauacugagaguugggacucuaaccucagaugacuuguuaauccuggccgcugaucuagagaaguugaagucaaaggugaccagaacagaaaggccauugagugcaggugucuauaugggcaaccuaagcucacagcaacucgaccaaagaagagcucuucugaacaugauaggaaugagugguaguaaucaaggggcucgggcugggagagauggagugguuagaguuugggaugugaaaaaugcagaguugcucaauaaucaguucgggacuaugccaaguuugacacuggcaugucugacaaaacaggggcagguugacuugaaugaugcaguacaagcauuaacagauuuagguuugaucuacacagcgaaguauccuaacacuucagacuuggacaggcugacucaaagucaccccauccuaaauaugauugacaccaagaagagcucuuugaauaucucagguuauaauuuuagcuugggugcagcugugaaggcaggagcuugcaugcuggaugguggcaauauguuggagacaaucaaggugucaccucagacaauggaugguauucucaaauccaucuuaaaggucaagaaggcucuugggauguucauuucagauaccccuggugaaaggaauccuuaugaaaacauacucuacaagauuuguuugucaggagauggauggccauacauugcaucaagaaccucaauaacaggaagggccugggaaaacacugucguugaucuggaaucagaugggaagccacagaaagcuggcagcaacgguuccaauaaaucucuacagucggcaggguuuaccgcugggcuuaccuauucucagcugaugacccucaaggaugcaaugcugcaacuugacccaaaugcuaagaccuggauggacauugaaggaaggccugaagauccaguggaaaucgccuucuaucaaccaagcucaggaugcuacauacauuucuuccgugaaccuacugacuuaaagcaguucaagcaggaugcuaaguacucacaugggauugaugucacggaccucuucgcugcacaaccgggccugaccagugcuguuauugaugcacucccccgaaauuuggucauuaccugucaggggucggaugacauaaggaaacucuuugaaucacaaggaagaaaagacaucaaacuaauugacauugcccucagcaaaacugauuccaggaaguaugaaaaugcagucugggaccaguauaaagacuuaugccacaugcacacagguauuguuguugagaagaagaaaagaggcgguaaagaggaaauaaccccucacugugcacuaauggacugcaucauguuugaugcagcagugucaggaggacugaacgcaucaguuuugagagcagugcugcccagagacaugguguucagaacaucaacaccuagagucguccuguaa

SEQ ID NO: 732 - RNA, 1710 nt, Artificial Sequence
  derived and/or modified CDS sequence (wt) from Lassa virus__AIT17815__NP
augagugccucaaaggaaauaaaauccuuuuuguggacacaauccuugaggagggaauuaucugguuacugcuccaacaucaaacugcagguggugaaggaugcccaggcucuuuuacaugggcuugacuucucugaagucaguaauguucaacgguugaugcgcaaggagagaagggaugacaaugauuugaaacgguugagggaccuaaaucaagcagucaacaaucuuguugaauuaaaaucaacucaacaaaagaguauacugagaguugggacucuaaccucagaugacuuauuaaucuuggccgcugaucuagagaaguugaagucgaaggugaccagaacagaaaggccauugagugcaggugucuauaugggcaaccuaagcucucagcaacuugaccaaagaagagcucuucuggacaugauaggaaugagugguaguaaucaaggggcucgggcugggagagauggaguggucagaguuugggaugugaaaaaugcagaguugcucaauaaucaguucgggaccaugccaagucugacacuggcaugucugacaaaacaggggcagguugacuugaaugaugcagugcaagcauugacagauuuagguuugaucuacacagcgaaguaccccaauacuucagacuuggacaggcugacucaaagucaucccauccuaaauaugauugacaccaagaaaagcucuuugaacaucucagguuauaauuuuagcuugggugcagcugugaaggcaggagcuuguaugcuggaugguggcaauauguuggagacaaucaaggugucaccucagacaauggauggcauucucaaauccauuuuaaaggucaagaaggcucuugggauguuuauuucagaugccccuggugaaaggaauccuuaugaaaacauacucuacaagauuuguuuaucaggagacggauggccauacauugcaucaagaaccucaauaacaggaagggccugggaaaacacuguuguugaccuggaaucagaugggaagccacagaaagcuggcaguaacgguuccaauaaaucucugcagucggcaggauuuaccgcugggcucaccuauucucagcugaugacccucaaggaugcaaugcugcaacuugacccaaaugcuaagaccuggauggacauugaaggaagaccugaagauccaguggaaaucgcccucuaucaaccaaguucagggugcuacauacacuucuuccgugaaccuacugauuuaaagcaguucaagcaggaugcuaaguacucacaugggauugaugucacggaccucuucgcugcacagccgggcuugaccagugcugucauugaugcacucccccggaauauggucaucaccugccagggaucugaugacauaaggaaacucuuugaaucacaaggaagaaaagacauuaaacuaauugacauugcccucagcaagacugauuccaggaaguaugaaaaugcagucugggaucaguauaaagauuuaugccacaugcauacagguauuguuguugagaagaagaaaagaggugguaaagaggaaauaaccccucacugugcauuaauggacugcaucauguuugaugcagcaguaucaggaggacugaacacaucaguuuugagagcagugcugcccagagacaugguguucagaacaucgacaccuagggucguccuguaa

SEQ ID NO: 733 - RNA, 1710 nt, Artificial Sequence
  derived and/or modified CDS sequence (wt) from Lassa virus__AIT17821__NP
augagugcuucaaaggaaauaaaguccuuucuguggacacaaucauuaaggagggaauugucugguuacugcuccaacaucaaacuacagguggugaaagaugcccaggcucuucugcauggacuugacuucuccgaaguaagcaauguucaacgguugaugcgcaaggagagaagggaugacaaugauuuaaagcgguugagggaccuuaaucaagcggucaacaaccuuguugaguuaaaaucaacucaacaaaagagcauauugagaguuggaaccuuaaccucagaugacuuauuaaucuuagcugcugaucuagagaagcugaaaucaaaggugaucaggacagaaaggccauugagugcaggugucuacauggguaaccugagcucacagcaacuugaccagagacgagcucuucugagcaugauagggaugaguggugguaaucagggggcucgggcugggagagaugggguggugagaguuugggaugugaaaaaugcagaauugcucaauaaucaguucgggaccaugccaagucuuacacuggcaugucugacaaaacagggacagguugacuugaaugaugcagugcaagcauugacagauuugggucugaucuacacggcgaaguaucccaauacuucagacuuggauaggcugacucaaagucaccccauccuaaacaugauugacaccaagaagagcucuuuaaacaucucagguuauaauuuuagcuugggugcagcugugaaggcgggagcuuguaugcuggaugguggcaacauguuggagacaaucaaggugucaccucagacaguggaugguauccucaaauccaucuugaaggucaagaaggcucuugggauguucaucucagacaccccuggugaaaggaauccuuaugagaacauacucuacaaaauuugccugucaggagauggguggccauacauugcaucaaggaccucaauaacaggaagggccugggaaaacacugucguugaucuggaaucagaugggaagccacagaaaacuggcagcaacaauuccaacaaaucccugcagucggcaggguuuaccgcugggcuuaccuauucucagcugaugacccucaaggaugcaaugcugcaacuugauccaaaugcaaagacuuggauggauauugaaggaagaccugaggauccaguggaaguugcccucuaucagccaaguucaggcuguuacauucacuucuuucgugaaccuacugauuuaaagcaguucaaacaggaugcuaaguacucacaugggauugaugucacagaccucuucgcugcacaaccgggccugaccagugcugucauagaugcacucccucggaauauggucauuaccugucagggguccgaugacauaaggaaacuccuugaaucacaagguaggaaagacaucaaacuaauugauauugcccucagcaaaacugauuccaggaaguaugaaaaugcagucugggaucaguauaaagacuuaugccacaugcacacaggugucguuguugagaagaagaaaagaggcgguaaagaggaaauaaccccucacugugcacuaauggacugcaucauguuugacgcagcagugucaggaggacugaacacaucgguuuugagagcagugcugcccagggauaugguguuuagaacaucaacaccuagagucguccuguaa

SEQ ID NO: 734 - RNA, 1710 nt, Artificial Sequence
  derived and/or modified CDS sequence (wt) from Lassa virus__AIT17837__NP
augagcaacuccaaggaaaucaaaucauuccuuuggacucaguccuuacgaagggaacuaucugguuacuguucuaacauaaaguugcaaguugucaaagaugcucaggcucuccugcauggccuugacuuuucugaggucagcaaugugcagaggcugaugcgcaagcagaagagagaugaugcagaccuaaagcgacugagggaucugaaucaagcugucaacaaucuuguugaacugaagucaacucaacagaagaaugucuuaagggucggcaccuugaguucagaugaucuaauaacuuuggcagcggaccuggaaaaacucaaguccaaagucauaaggacagaaaggccuuugagcucagguguuuacauggggaauuuaagcucacaacagcuugaucaaaggagggcucucuugagcaugauugggaugucagguggaccucaaggaaauaggacagguggggauggugucgucaggguuugggacguaaaaaaugcagaauuacucaauaaccaauuuggaaccaugccaagccucaccuuggcgugccucaccaaacaagggcaaguggaccucaaugaugcugugcaagcuuuaacagauuuagguuugauuuacacagcaaaguacccgaacucuucagaucuagacaugcucacucagagucacccuauacuaggaaugguugacacaaaaaagaguucccugaacaucucagguuacaacuucagucugggggcugcaguuaaagcuggugcuugcaugcuugaugggggcaacauguuggaaacaauaaaagugucaccacaaacaauggacgguauuuugaaaucuauucugaaggucaaaagaucacugggaauguucauuucugacacuccuggugaaagaaacccauaugagaacauccucuauaagaucugccuuucaggugaagguuggccguauauugcaucaagaacaucaauuacugggagagcuugggaaaacacucuuguugauuuggaaucugacaacaaaccaccgaaacuaaauagcgcugguuccaauaaaagcuugcaggcugcaggucuaaaugcuggguugaccuauucucaacugaugacacuaaaagauuguauguuacaguuggacccaaguagcaaaacauggauagauauugagggcaggccugaagacccaguggagauugcuuuguuucaaccaagcucugguuguuacauacacuuuuuuagagaaccuacugaccuuaagcaauucaaacaggaugcuaaguacucacaugggauagauguuacagaucuuuuuuccacacaacccgggcugacaagugcugucauagaggcacuuccccgcaauaugguguugaccugccaggggucagaugacaucaaaaagcuguuggagucucaagggagaagagacaucaaauugauugauauuucuuugagcaaagcagauucaaggaaguuugaaaaugcugugugggaccaauacaaagacuugugucacaugcacacgggaguagucguugagaagaaaaagagggguggaaaagaggaaaucaccccacauugcgcuuuacuggacugcaucauguuugaugcagcuacuacugguaguuugaacaucacaacacugagggcaguacuucccagagacauggucuucaggaccagcaccccuaaagucguucuguaa

SEQ ID NO: 735 - RNA, 1710 nt, Artificial Sequence
  derived and/or modified CDS sequence (wt) from Lassa virus__AIT17841__NP
augagugccucaaaggaaauaaaguccuuuuuguggacacaauccuugaggagggaauuaucugguuacugcuccaacaucaaacugcagguggugaaggaugcccaggcucuuuuacaugggcuugacuucucugaagucaguaauguucaacgguugaugcgcaaggagagaagggaugacaaugauuugaaacgguugagggaccuaaaucaagcagucaacaaucuuguugaauuaaaaucaacucaacaaaagaguauacugagaguugggacucuaaccucagaugacuuauuaaucuuggccgcugaucuagagaaguugaagucgaaggugaccagaacagaaagaccauugagugcaggugucuauaugggcaaccuaagcucacagcaacuugaccaaagaagagcucuucugaacaugauaggaaugagugguaguaaucaaggggcucggacugggagagauggaguggucagaguuugggaugugaaaaaugcagaguugcucaauaaucaguucggaaccaugccaagucugacacuggcaugucugacaaaacaggggcagguugacuugaaugaugcaguacaagcauugacagauuuagguuugaucuacacagcgaaguaccccaauacuucagacuuggacaggcugacucaaagucaccccauccuaaauaugauugacaccaagaaaagcucuuugaacaucucagguuauaauuuuagcuugggugcagcugugaaggcaggagcuuguaugcuggaugguggcaauauguuggagacaaucaaggugucaccucagacaauggaugguauucucaaauccauuuuaaaggucaagaaggcucuugggauguucauuucagaugccccuggugaaaggaauccuuaugaaaacauacucuacaagauuuguuugucaggagacggauggccauacauugcaucaagaaccucaauaacaggaagggccugggaaaacacuguuguugaucuggaaucagaugggaagccacagaaagcuggcaguaacgguuccaauaaaucucugcagucggcaggauuuaccgcugggcucaccuauucucagcugaugacccucaaggaugcaaugcugcaacuugacccaaaugcuaagaccuggauggacauugaaggaagaccugaagauccaguggaaaucgcccucuaucaaccaaguucagggugcuacauacacuucuuccgugaaccuacugauuuaaagcaguucaagcaggaugcuaaguacucacaugggauugaugucacggaccucuucgcugcacaaccgggcuugaccagugcugucauugaugcacucccccggaauauggucaucaccugccaggggucugaugacauaaggaaacucuuugaaucacaaggaagaaaagacauuaaacuaauugacauugcccucagcaagacugauuccaggaaguaugaaaaugcagucugggaucaguauaaagacuuaugccacaugcauacaggcauuguuguugagaagaagaaaagaggcggcaaagaggaaauaaccccucacugugcacuaauggacugcaucauguuugaugcagcaguaucaggaggacugaacacaucaguuuugagagcagugcugcccagagacaugguguucagaacaucgacaccuagggucguccuguaa

SEQ ID NO: 736 - RNA, 1710 nt, Artificial Sequence
  derived and/or modified CDS sequence (wt) from Lassa virus__AIT17845__NP
augagugccucaaaggaaauaaaguccuuuuuguggacacaauccuugaggagggaauuaucugguuacugcuccaacaucaaacugcagguggugaaggaugcccaggcucuuuuacaugggcuugacuucucugaagucaguaauguucaacgguugaugcgcaaggagagaagggaugacaaugauuugaaacgguugagggaccuaaaucaagcagucaacaaucuuguugaauuaaaaucaacucaacaaaagaguauacugagaguugggacucuaaccucagaugacuuauuaaucuuggccgcugaucuagagaaguugaagucgaaggugaccagaacagaaagaccauugagugcaggugucuauaugggcaaccuaagcucacagcaacuugaccaaagaagagcucuucugaacaugauaggaaugagugguaguaaucaaggggcucagacugggagagauggaguggucagaguuugggaugugaaaaaugcagaguugcucaauaaucaguucggaaccaugccaagucugacacuggcaugucugacaaaacaggggcagguugacuugaaugaugcaguacaagcauugacagauuuagguuugaucuacacagcgaaguaccccaauacuucagacuuggacaggcugacucaaagucaccccauccuaaauaugauugacaccaagaaaagcucuuugaacaucucagguuauaauuuuagcuugggugcagcugugaaggcaggagcuuguaugcuggaugguggcaauauguuggagacaaucaaggugucaccucagacaauggaugguauucucaaauccauuuuaaaggucaagaaggcucuugggauguucauuucagaugccccuggugaaaggaauccuuaugaaaacauacucuacaagauuuguuugucaggagacggauggccauacauugcaucaagaaccucaauaacaggaagggccugggaaaacacuguuguugaucuggaaucagaugggaagccacagaaagcuggcaguaacgguuccaauaaaucucugcagucggcaggauuuaccgcugggcucaccuauucucagcugaugacccucaaggaugcaaugcugcaacuugacccaaaugcuaagaccuggauggacauugaaggaagaccugaagauccaguggaaaucgcccucuaucaaccaaguucagggugcuacauacacuucuuccgugaaccuacugauuuaaagcaguucaagcaggaugcuaaguacucacaugggauugaugucacggaccucuucgcugcacaaccgggcuugaccagugcugucauugaugcacucccccggaauauggucaucaccugccaggggucugaugacauaaggaaacucuuugaaucacaaggaagaaaagacauuaaacuaauugacauugcccucagcaagacugauuccaggaaguaugaaaaugcagucugggaucaguauaaagacuuaugccacaugcauacaggcauuguuguugagaagaagaaaagaggcggcaaagaggaaauaaccccucacugugcacuaauggacugcaucauguuugaugcagcaguaucaggaggacugaacacaucaguuuugagagcagugcugcccagagacaugguguucagaacaucgacaccuagggucguccuguaa

SEQ ID NO: 737 - RNA, 1710 nt, Artificial Sequence
  derived and/or modified CDS sequence (wt) from Lassa virus__ANH09723__NP
augagugccucaaaagagauaaagucuuuuuuguggacacagucucugaggagggaauugucggguuacugcuccaacaucaaacuacagguggugaaagaugcccaggcucuuuuacauggacuugacuuuucugaggucagcaacguccaacggcugaugcgcaaacagagaagggaugacaaugaucuaaagcggcugagggauuuaaaucaagcaguuaacaaucuuguugaacuaaaaucaacucagcaaaagaguguguugagaguuggaacucuaaccucagaugacuuguugacauuagcugcugaccuagagaagcugaaaucaaagguaaccaggacagaaagaccauugaccgcaggcguuuacaugggcaacuuaaguucacaacagcuugaccaaagacgggcucuccugaauaugauaggaaugaguggugguaaccaaggggcucgaacugggagagaugggguagugagggucugggauguuaaaaaugcagaauugcucaacaaucaguuuggaacuaugccaagcuugacacuagcaugccugacaaagcaagggcagguugaccuaaaugauguggugcaagcacuaacagaucuaggccugaucuauacagcaaaguaucccaacacuucagaccuggacagacuaacucagagccaucccauccuaaacaugauugauacuaauaaaagcucccuaaauaucucagguuauaauuuuagcuugggugcagcugugaaggcaggagcuugcaugcuggaugguggaaacaugcuagagacaaucaaagugucaccccaaacaauggauggcauccucaaguccauuuuaaagguaaaaaagagucuugggauguucauuucagacacccccggcgagagaaaucccuaugaaaauauacucuacaagauuugucugucgggggauggguggccauauauugcaucaaggaccucaauaacaggaagggccugggaaaauacuguuguugaucuagaaucaggugggaagccacagaaagcugguagcaacaacuccaacaagucccuacaaucggcaggauuugcugcugggcucacuuauucucaguuaaugacccucaaggaugcaauguugcaacuugauccaaaugcuaagaccuggauggauauugagggaaggccugaagacccaguggagauugcucucuaucagccaauuucggguugcuacauucacuucuuccgugaaccuacugaucugaaacaguucaagcaagaugcuaaguauucacauggaauugauguuacagaccuuuuugcugcacaaccaggauuaacuagugcugugauagaagcacucccccggaacauggucaucaccugucaaggaucugacgacauaaggaaacuuuuugagucacaaggaaggaaagacaucaagcugauugauauugcucucagcaaaacugauucuagaaaauaugaaaacgcagucugggaccaguacaaagauuuaugucauaugcacacagguguuguuguugagaagaaaaagaagggcggcaaagaagaaauaaccccucauugugcucuaauggacugcaucauguuugaugcagcaguaucaggagggcugaacacgcugguuuugagagcagugcuaccuagagauaugguguucagaacaucaacaccuaaagucguccuguaa

SEQ ID NO: 738 - RNA, 1710 nt, Artificial Sequence
  derived and/or modified CDS sequence (wt) from Lassa virus__ANH09725__NP
augagugccuccaaggagauaaaguccuucuuguggacacagucucugaggagagaacugucggguuacugcucuaacaucaaacuacagguggugaaagacgcccaggcucuuuugcauggacuugacuucucugaggucagcaauguccaacgguugaugcgcaaacagaggagggaugacaaugaccuaaagcggcugagggauuuaaaucaggcaguuaacaaccuuguugaauuaaaaucaacucagcaaaagaguguguugaggguugggacucuaaccucagaugaccuguugauauuagcugcugacuuagagaagcugaaaucaaagguaaccaggacagaaagaccauuaagugcagguguuuauaugggcaacuuaagcucacaacagcuugaccaaagacgggcucuuuugaacaugauaggaaugaguggugguaaccaaggggcccgagcugggagagaugggguagugagggucugggaugucaaaaaugcagauuugcucaacaaucaauuuggaacuaugccaagccuaacacuggcaugcuuaacaaagcaggggcagguugaccuaaaugauguaguucaagcgcuuacagaucuaggccugaucuacacagcaaaguaccccaacacuucagauuuagacagacuaacucagagucauccuauccuaaacaugauugacaccaauaaaagcucccuaaauaucucagguuauaauuuuagcuugggugcagcugugaaggcaggagcuugcaugcuagaugguggaaacaugcuagagacaauuaaagugucaccccaaacaauggauggcauccuuaagucuauuuuaaagguaaaaaagagucuugggauguuuauuucagauaccccuggcgagagaaacccuuaugaaaacauacucuacaagaucugucugucgggggauggguggccauacauugcaucaaggaccucaauaacaggaagggcuugggaaaauaccguuguugauuuagaaucaggugggaaaccacagaaagcuggaagcaauaacuccaacaaguccuuacaaucggcgggguuugcugcuggacucacuuauucucaguuaaugacccucaaggaugcaaugcugcaacuugacccuaaugcuaagaccuggauggacauugagggaaggccugaagauccgguggagauugcucucuaucaaccaauuucagguugcuacauucacuucuuccgugaaccuaccgaucugaagcaguuuaagcaagaugcuaaguauucacauggaauugaugucacagaccuuuuugcugcacaaccaggacuaacuagugcugugauagaagcacucccccggaacauggucaucaccugucagggaucugaugacauaagaaaacuucuugagucacaaggaaggaaagacaucaagcugauugauauugcucucagcaaaacugauucuagaaaauaugagaacgcagucugggaucaguacaaagauuuaugccauaugcacacagguguuguuguugagaagaaaaagaggggcggcaaagaagaaauaaccccucauugcgcucuaauggacugcaucauguuugaugcagcaguaucaggagggcugaacacauugguuuugagggcagugcuaccuagggauaugguguucagaacaucaacaccuaaagucguccuguaa

SEQ ID NO: 739 - RNA, 1710 nt, Artificial Sequence
  derived and/or modified CDS sequence (wt) from Lassa virus__ANH09729__NP
augagugccucaaaagagauaaaguccuucuuguggacacagucccugaggagagaauugucggguuacuguucuaacaucaaacuacagguggugaaagaugcccaggcccuuuugcauggacuugacuuuucugaggucagcaacguccaacgauugaugcguaaacagaggagggaugacagugaccuaaagcggcugagggauuugaaucaagcaguuaacaaucuuguugaacuaaaaucaacucagcaaaagaguguguugagaguuggaacucuaaccucagaugacuuguugacauuagcugcugaccuagagaagcugaaaucaaagguaaccagaacagaaagaccauugagcgcaggcguuuacaugggcaacuuaagcucacaacagcuugaccaaagacgggcucuccugaauaugauaggaaugaguggugguaaccaaggggcucgaacugggagagaugggguaguaagggucugggaugucaaaaaugcagauuugcucaacaaucaguuuggaacuaugccaagcuugacuuuggcaugcuugacaaagcaagggcagguugaccugaaugauguggugcaagcgcuaacagaucuaggccugaucuacacagcaaaguaccccaacacuucagacuuagacagacuaacucagagccaucccauccuaaacaugauugacaccaauaaaagcucccuaaauaucucagguuauaauuuuagcuugggugcagcugugaaagcaggagcuugcaugcuagaugguggaaacaugcuggagacaauuaaagugucaccccaaacaauggauggcauccuuaagucuauuuuaaagguaaaaaagagucuugggauguucaucucagacaccccuggcgagagaaauccuuaugaaaacauacucuacaagaucugucugucaggggauggguggccauauauugcaucaaggaccucaauaacaggaagggccugggaaaacacuguuguugauuuagaaucaggugggaaaccacagagagcuggaagcaacaacuccaacaagucccuacaaucggcgggauuugcugcugggcuuacuuauucucaguuaaugacccucaaagaugcaauguugcaacuugauccaaaugcuaagaccuggauggauauugagggaaggccugaagauccaguggagauugcccucuaucagccaacuucggguugcuacauucacuucuuccgugaaccuacugaucugaagcaguucaagcaagaugcuaaguauucacaugggauugauguuacagaccuuuuugcugcacaaccaggauuaacuagugcugugauagaagcacucccccggaacauggucaucaccugucagggaucugacgacauaagaaagcuucuugaaucacaagggaggaaagacaucaagcuaauugauauugcucucagcaagacugauucuagaaaauaugaaaacgcagucugggaucaguacaaagauuuaugucacaugcacacagguguuguuguugagaagaaaaagaagggcgguaaagaagaaauaaccccucauugcgcucugauggacugcaucauguuugaugcagcaguaucaggagggcuaaacacacugguuuugagagcagugcuaccuagggauaugguguucagaacaucaacaccuaaagucguccuguaa

SEQ ID NO: 740 - RNA, 1710 nt, Artificial Sequence
  derived and/or modified CDS sequence (wt) from Lassa virus__ANH09731__NP
augagugccucaaaagagauaaaguccuuccuguggacacagucucugaggagagaauugucggguuacugcuccaacaucaaacuacagguggugaaagaugcccaggcucuuuugcauggacuugacuuuucugaggucagcaacguccaacgguugaugcguaaacagaggagggaugacaaugaccuaaagcggcugagggauuuaaaucaagcaguuaacaaucuuguugagcuaaaaucaacucagcaaaaaaguguguugagaguuggaacucuaaccucagaugacuuguugacauuagcugcugaccuagagaagcugaaaucaaagguaaccaggacagaaagaccauugagcgcaggcguuuauaugggcaacuuaagcucacaacaacuugaccaaagacgggcucuccugaauaugauaggaaugacuggugguaaccaaggggcucgaacugggagagaugggguagugagggucugggaugucaaaaaugcagauuugcucaacaaucaguuuggaacuaugccaagcuugacauuggcauguuuaacaaagcaagggcagguugaccuaaaugauguggugcaagcgcuaacagaucuaggccugaucuacacagcaaaguaccccaacacuucagacuuagauagacuaacucagagccaucccauccuaaacaugaucgacaccaauaaaagcucccuaaauaucucagguuauaauuuuagcuuaggugcagcugugaaggcaggagcuugcaugcuggaugguggaaacaugcuagagacaauuaaagugucaccccaaacaauggauggcauccucaagucuauuuuaaagguaaaaaagagucuugggauguucauuucagacaccccuggcgagagaaauccuuaugaaaacauacucuacaagaucugucugucaggggauggguggccauacauugcaucaaggaccucaauaacaggaagggccugggaaaacacuguuguugauuuagaaucaggugggaaaccacagagagcuggaagcaacaacuccaacaagucccuacaaucggcaggauuagcugcugggcuuacuuauucucaguuaaugacccucaaggaugcaauguugcaacuugauccaaaugcuaagaccuggauggauauugagggaaggccugaagauccgguggagauugcucucuaucagccaacuucggguugcuacauucacuucuuucgugaaccuaccgaucugaagcaguucaagcaagaugcuaaguauucacaugggauugauguuacagaccuuuuugcugcacaaccaggauuaacuagugcugugauagaagcacucccccggaacauggucaucaccugucaaggaucugacgacauaagaaaacuucuugaaucacaaggaaggaaagacaucaagcugauugauauugcucucagcaaaacugauucuagaaaauaugaaaacgcagucugggaucaguacaaagauuuaugucacaugcacacagguguuguuguugagaagaaaaagaagggcgguaaggaggaaauaaccccucauugcgcucugauggacugcaucauguuugacgcagcaguaucaggagggcuaaacacacuggucuugagagcagugcuaccuagggauaugguguucagaacaucaacaccuaaagucguccuguaa

SEQ ID NO: 741 - RNA, 1710 nt, Artificial Sequence
  derived and/or modified CDS sequence (wt) from Lassa virus__ANH09733__NP
augagugccucaaaagagauaaaguccuucuuguggacacagucucugaggagagaauugucggguuacugcucuaacaucaaacuacagguggugaaagaugcccaggcucuuuugcauggacuugacuucucugaggucagcaacguccaacgguugaugcgcaaacagaggagggaugacaaugaccuaaagcggcugagggauuuaaaucaagcaguuaacaaucuuguugaacuaaaaucaacucagcaaaagaguguauugagaguuggaacucuaaccucagaugaccuguugacauuagcugcugaccuagagaagcuaaaaucaaagguaaccaggacagaaagaccauugagcgcaggcguuuauaugggcaacuuaagcucacaacagcuugaccaaagacgggcucuccugaauaugauaggaaugaguggugguaaccaaggggcucgaacugggagagaugggguagugagggucugggaugucaaaaaugcagaucugcucaacaaucaguuuggaacuaugccaagcuugacacuggcaugcuugacaaagcaggggcagguugaccuaaaugauguggugcaagcacuaacagaucuaggccuaaucuacacagcaaaguaccccaacacuucagacuuagacagacuaacucagagccaccccauccuaaacaugauugacaccaauaaaagcucccuaaacaucucagguuauaauuuuagcuuaggugcagcugugaaggcaggagcuugcaugcuggauggugggaacaugcuagagacaauuaaaguaucaccccaaacaauggauggcauccuuaagucuauuuuaaagguaaaaaagagucuugggauguucauuucagacaccccuggcgagagaaauccuuaugaaaacauacuuuauaagaucugucugucgggggauggguggccauauauugcaucaagaaccucaauaacagggagggcuugggaaaauacuguuguugauuuagaaucaggugggaaaccacagagagcuggaagcaacaacuccaacaagucccuacaaucggcaggguuugcugcugggcucacuuauucucaguugaugacucucaaggaugcaaugcugcaacuugauccaaaugcuaagaccuggauggauauugagggaaggccugaagauccgguggagauugcuuucuaucagccaauuucagguugcuacauucacuucuuccgugaaccuacugaucugaagcaauuuaagcaagaugcuaaguauucacauggaauugaugucacagaccuuuuugcugcacaaccaggauuaacuagugcugugauagaagcacucccccggaacauggucauuaccugucagggaucugaugacauaagaaaacuucuugagucacaaggaaggaaagacaucaagcugauugauauugcucucagcaaaacugauucuagaaaauaugaaaacgcaguaugggaucaguauaaagauuugugucacaugcacacaggcguuguuguugagaagaagaagaagggcggcaaagaagaaauaaccccucauugcgcucuaauggacugcaucauguuugaugcagcaguaucgggagggcugaacacacugguuuugagagcagugcuaccuagggauaugguguucagaacaucaacaccuaaagucguccuguaa

SEQ ID NO: 742 - RNA, 1710 nt, Artificial Sequence
  derived and/or modified CDS sequence (wt) from Lassa virus__ANH09735__NP
augagcgcuucaaaggaagugaaaucauuccuauggacucaguccuugaggagagaguugucuggcuacugcuccaacauaaaguugcaaguggucaaggacgcucaagcccuccuacauggucuugauuuuucggaagucagcaauauacagcgauuaaugcgcaaagagaggagggaugauagugaccugaaacgccucagagacuuaaaucaggcagucaacaaccuugucgaacugaaauccacacagcaaaaaaguguucuuagagucgggacucucagcucugaugaucuguugacuuuagcugcugauuuagagaaguugaaaucuaaggugauucgcacugagaggccguuaagcucaggugucuauaugggaaauuugagcacccagcaacuagaccagaggagggcccugcugaacaugauuggcaugacuaaugguggccaaggggcaaaugcuggaagagacggcauuguaagggucugggauguuaagaaugcagaacuguugaauaaucaauucgggacaaugccaagcuugaccuuggccuguuuaacaaaacaaggacagguggaccugaaugaugcuguccaagccuugacagauuuaggacugauuuauacugcaaaguacccaaacucaucugacuuagauaggcucucucagaaccaccccauacuaaacaugauugacaccaagaagagcucccucaacauaucugguuacaauuuuagucugggugccgcaguaaaggcgggggcuugcaugcuugaugguggcaacauguuggaaacaaucaagguuucaccacaaacuauggaugggauccuaaaaucaaucuugaaggucaaaaggagcuuggggauguuugugucagauacuccaggugagagaaauccauaugaaaauauacuguacaagaucugcuugucaggagauggauggccuuauguugcaucaagaaccucuaucauuggcagagcuugggaaaacacugugguagaucuggagucagacagcaagccucaaagaccugggagcaaggaauccaacagaucauugcagacggcugguuucccagcaggacuaaccuacucacagcucaugacucucaaggauucuauguugcaguuggauccuaaugcuaagaccuggauggacaucgaagggagaccagaugauccaguugagauugccuuauaucagccaagcucagguuguuacauucauuucuuuagagaaccaacugaucugaagcaauuuaaacaggaugcaaaauacucacacgggauugacauaggugaucuauuugcugcgcagcccggccugacaagugcaguaauagaagcacuuccacggaacaugguaaucaccugccaagggucagaggacaucaagagacuccuagagucucaggggaggaaagacauaagacugguagacauuucuuugaguaaggcagauucuagaaaguuugaaaaugcugucugggaucaauuuaaagaucuguguaacaugcauacaggugucguuguugagaagaagaagaaggguggcaaagaagaaauaacaccacacugugcacugauggacugcaucauguuugaugcagcugucaugggugggcucgaugcgaaagucuuaagagcugugcuacccaaagacauggucuucaggaccucaacacccagagucguccuguaa

SEQ ID NO: 743 - RNA, 1710 nt, Artificial Sequence
  derived and/or modified CDS sequence (wt) from Lassa virus__ANH09737__NP
augagcgcuucaaaggaagugaaaucauuccuauggacucaguccuugaggagagaguugucuggcuacugcuccaacauaaaguugcaaguggucaaggacgcucaagcccuccuacauggucuugauuuuucggaagucagcaauauacagcgauuaaugcgcaaagagaggagggaugauagugaccugaaacgccucagagacuuaaaucaggcagucaacaaccuugucgaacugaaauccacacagcaaaaaaguguucuuagagucgggacucucagcucugaugaucuguugacuuuagcugcugauuuagagaaguugaaaucuaaggugauucgcacugagaggccguuaagcucaggugucuauaugggaaauuugagcacccagcaacuagaccagaggagggcccugcugaacaugauuggcaugacuaaugguggccaaggggcaaaugcuggaagagacggcauuguaagggucugggauguuaagaaugcagaauuguugaauaaucaauucgggacaaugccaagcuugaccuuggccuguuuaacaaaacaaggacagguggaccugaaugaugcuguccaagccuugacagauuuaggacugauuuauacugcaaaguacccaaacucaucugacuuagauaggcucucucagaaccaccccauacuaaacaugauugacaccaagaagagcucccucaacauaucugguuacaauuuuagucugggugccgcaguaaaggcgggggcuugcaugcuugaugguggcaacauguuggaaacaaucaagguuucaccacaaacuauggaugggauccuaaaaucaaucuugaaggucaaaaggagcuuggggauguuugugucagauacuccaggugagagaaauccauaugaaaauauacuguacaagaucugcuugucaggagauggauggccuuauguugcaucaagaaccucuaucauuggcagagcuugggaaaacacugugguagaucuggagucagacagcaagccucaaagaccugggagcaaggaauccaacagaucauugcagacggcugguuucccagcaggacuaaccuacucacagcucaugacucucaaggauucuauguugcaguuggauccuaaugcuaagaccuggauggacaucgaagggagaccagaugauccaguugagauugccuuauaucagccaagcucagguuguuacauucauuucuucagagaaccaacugaucugaagcaauuuaaacaggaugcaaaauacucacacgggauugacaugggugaucuauuugcugcgcagcccggccugacaagcgcaguaauagaagcacuuccacggaacaugguaaucaccugccaagggucagaggacaucaagagacuccuagagucucaggggaggagagacauaagacugguagacauuucuuugaguaaggcagauucuagaaaguuugaaaaugcugucugggaucaauuuaaagaucuguguaacaugcauacaggugucguaguugagaagaagaagaaggguggcaaagaagaaauaacaccacacugugcacugauggacugcaucauguuugaugcagcugucaugggugggcucgaugcgaaagucuuaagagcugugcuacccaaagacauggucuucaggaccucaacacccagagucguccuguaa

SEQ ID NO: 744 - RNA, 1710 nt, Artificial Sequence
  derived and/or modified CDS sequence (wt) from Lassa virus__ANH09739__NP
augagcgcuucaaaggaagugaaaucauuccuauggacucaguccuugaggagagaguugucuggcuacugcuccaacauaaaguugcaaguggucaaggacgcucaagcccuccuacauggucuugauuuuucggaagucagcaacauacagcgauuaaugcgcaaagagaggagggaugauagugaccugaaacgccucagagacuuaaaucaggcagucaacaaccucgucgaacugaaauccacacagcaaaaaaguguucuuagagucgggacucucagcucugaugaucuguugacuuuagcugcugauuuagagaaguugaaaucuaaggugauucgcacugagaggccguuaagcucaggugucuauaugggaaacuugagcacccagcaacuagaccagaggagggcccugcuaaacaugauuggcaugacuagugguggccaaggggcaaaugcuggaagagacggcauuguaagggucugggauguuaagaaugcagaacuguugaauaaucaauucgggacaaugccaagcuugaccuuggccuguuuaacaaaacaaggacagguggaccugaaugaugcuguucaagccuugacagauuuaggacugauuuauacugcaaaguacccaaacucaucugacuuagauaggcucucucagaaccaccccauacuaaacaugauugacaccaagaagagcucccucaacauaucugguuacaauuuuagucugggugccgcaguaaaggcgggggcuugcaugcuugaugguggcaacauguuggaaacaaucaagguuucaccacaaacuauggaugggauccuaaaaucaaucuugaaggucaaaaggagcuuggggauguuugugucagauacuccaggugagagaaauccauaugaaaauauacuguacaagaucugcuugucaggagauggauggccuuauguugcaucaagaaccucaaucauuggcagagcuugggaaaacacugugguagaucuggagucagacagcaagccucaaagaccugggagcaaggaauccaacagaucauugcagacggcugguuucccagcaggacuaaccuacucacagcucaugacucucaaggauucuauguugcaguuggauccuaaugcuaagaccuggauggacaucgaagggagaccagaugauccaguugagauugccuuauaucagccaagcucagguuguuacauucauuucuuuagagaaccaacugaucugaagcaauuuaaacaggaugcaaaauacucacacgggauugacauaggugaucuauuugcugcgcagcccggccugacaagugcaguaauagaagcacuuccacggaacaugguaaucaccugccaagggucagaggacaucaagagacucuuagagucucaggggaggagagacauaagacugguagacauuucuuugaguaaggcagauucuagaaaguuugaaaaugcugucugggaucaauuuaaagaucuguguaacaugcauacaggugucguaguugagaagaagaagaaggguggcaaagaagaaauaacaccacacugugcacugauggacugcaucauguuugaugcagcugucaugggugggcucgaugcgaaagucuuaagagcugugcuaccuaaagacauggucuucaggacuucaacacccagagucguccuguaa

SEQ ID NO: 745 - RNA, 1710 nt, Artificial Sequence
  derived and/or modified CDS sequence (wt) from Lassa virus__ANH09741__NP
augagcaacucaaaggaggugaaaucuuuccuuuggacucagucucucagaagagaacugucugguuauugcaccaacauaaagcuucaaguugucaaagaugcucaggcacuauugcauggccuugacuucucugaaguuagcaauguccaacgucucaugcguaaacagaaaagagaugauaaugauuuaaagaggcuuagagacuugaaucaggccgucaacaaucuaguggaacuaaaaucagugcaacaaaagagcguccuuaaaguugggacacugaauucagaugaucuccugacauuagcugcagaucuggagaagcucaaaucuaaggugguuagaacugaaaggccucugagcucugguguuuacaugggcaaucuuaguucacaacagcuugaccaaaggagagcacuucuaaacaugauuggaauggcuggcgguagucagggaaaccaaccuagccgagaugguguagucagaguaugggaugucaaaaaugcagaccuacucaacaaccaauuuggcacaaugccaagucuuacauuagcaugucugacaaagcagggccaaguugacuuaaaugauguuguguuggcucugacugauuugggccuuauauacacagccaaauacccuaauucaucagauuuagauaggcugucucagaaccacccaguucugaacaugauugaugucaacaagaguucccuaaacauuucgggcuacaauuucagccugggggcagcagugaaagcuggagcuugcaugcuugauggcgggaacaugcuugagacaaucaagaucuccccucaaacaguggacggcauccugaaaucgaucuugaagguuaaaagggcuuuagggauguuugugucagacaccccuggugaaaggaacccuuaugagaacauacuguauaagguaugucuuucagggaauggguggccauacauagcuucaagaacaucaauuguugggagagcaugggaaaauacugugguagaucuugagucaaacaaaaaucagccuaagguugggaacaauggauccaacaagaugcugcagucuucgggauuugcuacugguuugacuuauucucaguugaugacuuugagggauucaauguuacaguuggacccaacugcaaagaccuggauugacauugaggguagaccugaagacccuguugaguuggcccucuuucagcccaguucaggguguuacauacauuucuuuagagagccuacugaccuaaagcaauucaaacaggaugcaaaauacucucaugggauugaugugaaugauuuguucucggcacaaccugguuuaaccagugcuguuuuggaagcacuaccacguaauauggugcugacuugucaaggcucugaugacauuagaaagcuuuuggacucacaggacaggaaagauauaaagcuaauugacaucucauugagcaaggcugaugcaaggaaguucgagaacgaugugugggaucaauuuaaggauuuaugccauaugcacaccgggauaguugucgagaagaagaagaaaggagggaaacaggaaaugacaccacacugugcauugcuagauuguaucauguuugaugcagcugucucuggggggcuuaauguccccacuuugagagcagugcuucccaccgacauggucuucagaacaauaacaaccaaagucguccuguaa

SEQ ID NO: 746 - RNA, 1713 nt, Artificial Sequence
  derived and/or modified CDS sequence (wt) from Lassa virus__CAA36646__NP
augagugcuuccaaggaagugaggucauucuuguggacucaaucccuaagaagggaacuaucuggcuacuguuccaacauaaaguugcagguaguuaaagacgcucaagcucuccuucauggucuugacuucuccgaggucaguaauguucagagauugaugcgcaagcagaaaagagaugauggcgaccuaaaacgacugagagaucucaaucaagcagucaacaaucuuguugagcucaaauccacacagcagaaaagugucuuaagaguuggaaccuuaaguucagacgaucuacuaauccuggccgcugauuuagaaaaacugaaaucaaaagucaccagaacagaaaggccuuugaguucaggaguuuauauggggaauuugaguucacaacagcuugaucaaaggagagcccuuuugaacaugauuggcaugacuggaguaaguggagggggaaagggugccagugauggcauugugagaguuugggaugucaaaaaugcagaguuacucaacaaucaguucggaacaaugccaagccuaacuuuagcaugccugaccaaacaggggcaaguggaccugaaugaugccguucaagcuuugacagauuuagggcugauuuacacagccaaauaccccaacucaucugaucucgacagauugucucagagucauccaauucugaauaugauugacacuaagaaaaguucacucaacaucucugguuacaauuucaguuugggugcugcugucaaagcaggggccugcaugcuugauggugguaacauguuagagacuauuaagguuucaccucagaccauggaugguaucuugaagucaaucuugaaaguuaagaagagucugggaauguuuguaucagacacaccgggugaaaggaacccuuaugagaacauccuauacaagaucugucucucaggagacggauggcccuauauugcaucaaggaccucgauugugggaagagcaugggaaaauacugugguggaccuugagcaagacaacaagccccagaaaauuggaaaugggggguccaacaagucauuacagucugcaggcuuugcugcaggauuaacuuacucucaguugaugacucucaaagauuucaagugcuucaacuugauucccaacgcaaaaaccuggauggauauugaaggaagaccagaagacccaguugagauagcccuuuaucaaccgagcucggguugcuauguacauuucuuuagggagccaacagauuugaagcaauucaaacaagaugcaaaguauucacaugguauugaugugacugauuuguuugcugcccaaccuggguuaaccagugcagugauagaagcccuuccucggaacauggucaucacuugccaaggaucagaggauaucagaaaacuccuugagucacaagggaggagagacauaaaacugauugacaucacucuuaguaaagcagauucaagaaaguuugagaaugcuguuugggaucaauucaaggaucuaugucacaugcacacugggguaguuguggagaaaaagaagagaggugguaaagaggaaauaacuccucauugugcacugauggauugcauuauguuugaugcagcaguuucaggaggacuugaugcaaaaguccugagaguugugcucccuagagacaugguguucagaacuucaacaccuaaagucguccuguaa

SEQ ID NO: 747 - RNA, 1710 nt, Artificial Sequence
  derived and/or modified CDS sequence (wt) from Lassa virus__CCA30315__NP
augagugccuccaaagaagugaaaucuuucuuauggacacaaucucugaggagggaguugucggguuacuguuccaauaucaaacuucaaguggugaaggacgcucaagcucucuugcaugggcuugacuucucugaggucagcaauguccagcggcugaugcgcaaacaaaggagagaugauagugaccuaaagcgucuuagggaucugaaucaagcugucaacaaucuuguugagcugaaaucgacacaacagaaaagugugcugagaguugggacccuaaguucggacgauuuacugacucuggcggcugauuuagaaaagcugaaaucaaaaguuacaagaacagaaaggcccuugaguucaggugucuacaugggaaaccuaaguucacagcagcucgaucagaggagggcacuucuaaauuugauugggaugacaaacggcagucaggggucacaggcugggagagauggagugguaagagucugggaugugaagaaugcagaauuguugaacaaucaauuugggacaaugccgagccugacauuagcaugucugacaaagcagggacaaguugacuuaaaugaugugguacaagcacucacagaucugggcuugauuuauacagcuaaauauccuaacacaucagauuuagauagguuaacucaaagucaucccauuuuaaacaugauugacaccaagaagagcucccugaacaucucaggcuacaauuuuagucugggugccgcagugaaagcaggugccugcaugcuggaugguggcaacauguuagaaacaaucaagguuucgccucaaucaauggauggcauuuuaaaauccaucuugaaggucaagagggcucuugggauguucgucucagauacuccgggugagagaaaccccuaugaaaacauacucuacaaaaucugcuuaucaggugacggguggccauacauugcaucuaggacaucaauaguaggaagggcuugggaaaacacuguaguggaccuugaaacagaugggaaaccacagaaaauuggcagugguaacuccaacaaaucucuccaaucugcaggcuucucggcuggacuaacuuacucccaacuuaugacccuuaaagaugcaauguugcagcuugacccaaaugccaagacguggauggacauagaagggaggccagaggacccgguggaaguugcucucuaucagccuaucucuggguguuauauacacuuuuucagagagcccacugaucucaaacaauuuaaacaagaugcaaaauauucucauggaauugacaucgcagaucuguuugcugcacaaccaggucugaccagugcuguuauugaggcgcucccccggaauaugguuaucacuugccaaggguccgaagacauaaagaagcuucuugaaucacaagggagaaaggauauaaaacugauugacauugcucuuaguaagauugauucaagaaaguuugaaaaugcuguuugggaucaauauaaagauuugugucacaugcacacagguguuguuguugagaagaagaagagagguggcaaagaagagaucaccccucacugugcauugauggauugcaucauguuugaugcugcugucucaggaggguugaacacacuggugcucagagcugugcuacccagagacaugguguuuagaacaucaacaccaagagucguccuguaa

SEQ ID NO: 748 - RNA, 1710 nt, Artificial Sequence
  derived and/or modified CDS sequence (wt) from Lassa virus__JX985061__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagggaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaggucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaaugcagaguugcucaguaaucaguucgggaccauuccaagucugacacuggcaugucugacaaaacaggggcagguugacuugaaugaugcaguacaagcauugacagauuuggguuugaucuacacagcaaaguaucccaacacuucagacuuagacaggcugacucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucagaugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugaccucaguaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 749 - RNA, 1710 nt, Artificial Sequence
  derived and/or modified CDS sequence (wt) from Lassa virus__NP_694869__NP
augagugccucaaaggaaauaaaauccuuuuuguggacacaaucuuugaggagggaauuaucugguuacugcuccaacaucaaacuacagguggugaaagaugcccaggcucuuuuacauggacuugacuucuccgaagucaguaauguucaacgguugaugcgcaaggagagaagggaugacaaugauuugaaacgguugagggaccuaaaucaagcggucaacaaucuuguugaauuaaaaucaacucaacaaaagaguauacugagaguugggacucuaaccucagaugacuuauuaaucuuagccgcugaucuagagaaguuaaagucaaaggugaucagaacagaaaggccauuaagugcaggugucuauaugggcaaccuaagcucacagcaacuugaccaaagaagagcucuccugaauaugauaggaaugaguggugguaaucaaggggcucgggcugggagagauggaguggugagaguuugggaugugaaaaaugcagaguugcucaauaaucaguucgggaccaugccaagucugacacuggcaugucugacaaaacaggggcagguugacuugaaugaugcaguacaagcauugacagauuuggguuugaucuacacagcaaaguaucccaacacuucagacuuagacaggcugacucaaagucaucccauccuaaauaugauugacaccaagaaaagcucuuugaauaucucagguuauaauuuuagcuugggugcagcugugaaggcaggagcuugcaugcuggaugguggcaauauguuggagacaaucaaggugucaccucagacaauggaugguauccucaaauccauuuuaaaggucaagaaggcucuuggaauguucauuucagacaccccuggugaaaggaauccuuaugaaaacauacucuacaagauuuguuugucaggagauggauggccauauauugcaucaagaaccucaauaacaggaagggccugggaaaacacugucguugaucuggaaucagaugggaagccacagaaagcugacagcaacaauuccaguaaaucccugcagucggcaggguuuaccgcugggcuuaccuauucucagcugaugacccucaaggaugcaaugcugcaacuugacccaaaugcuaagaccuggauggacauugaaggaagaccugaagauccaguggaaauugcccucuaucaaccaaguucaggcugcuacauacacuucuuccgugaaccuacugauuuaaagcaguucaagcaggaugcuaaguacucacaugggauugaugucacagaccucuucgcuacacaaccgggcuugaccagugcugucauugaugcacucccccggaauauggucauuaccugucagggguccgaugacauaaggaaacuccuugaaucacaaggaagaaaagacauuaaacuaauugauauugcccucagcaaaacugauuccaggaaguaugaaaaugcagucugggaccaguauaaagacuuaugccacaugcacacaggugucguuguugaaaagaagaaaagaggcgguaaagaggaaauaaccccucacugugcacuaauggacugcaucauguuugaugcagcagugucaggaggacugaacacaucgguuuugagagcagugcugcccagagauaugguguucagaacaucgacaccuagagucguucuguaa

SEQ ID NO: 750 - RNA, 1710 nt, Artificial Sequence
  derived and/or modified CDS sequence (wt) from Lassa virus__SCA79106__NP
augaguaacucuaaagaggugaagucuuuucucuggacucagucucugaggagagagcugucagguuacugcucuaacaucaaacuccagguggucaaggaugcucaggccuuauuacaugggcuugauuucucugaagugagcaauguucagaggcugaugcgaaaacagaagagggaugauggugaccucaagaggcucagagaccugaaucaagcgguaaauaaucuuguugaacuaaaaucaguucaacaaaaaaguauauugagaguuggcacccugaccucugaugacuuacuaacacuugcugcugaccuagaaaaacuaaagucuaaaguaacuaggacugaaagaccuuugaguucaggaguuuauaugggaaaccucagcucucagcaacuugaccagaggagagcccuccugagcaugauagggaugaguggugggaaccagaacagccaacccaaaggagaugguguugugaggguuugggaugugaaaaaugcugaccugcugaacaaccaguuuggaacgaugcccagucuuacauuagcaugcuuaacaaagcagggacaaguggauuugaaugaugcuguucaggcacugacugaucuaggguugauuuacacagcuaaauacccgaacucaucugaccuagacagacuuucacaaagccauccaauccugaacaugaucgauaccaagaagagcucauugaacaucucuggcuacaauuuuaguuuaggggccgcaaucaagacuggggcaugcaugcuugaugggggcaacaugcuggagacaaucaaggucacuccccaaaccauggaugggauuuugaaauccauuuuaaaggugaagaggagucuugggauguuuauuucugauacaccuggagaaaggaauccuuaugaaaacauucuuuauaaaaucugucuuucaggagacggguggccuuacauagccucacgaacugccaucauugguagagcaugggaaaacacugugguugauuuggagucugauagcaagccacaaaagauugggagcaauggaucuaacaaaucauugcaaucugcaggcuuugccccuggacugacauacucucagcucaugacccucaaagacucaauguugcaauuagauccuaaugcaaagacuuggauagacauugaagguaggccggaagacccuguugaggucgccuuguuucagccuaucucagguugcuacauacacuucuuuagagaaccaacagaccugaagcaauuuaaacaagaugcaaaguacucacaugggauagaugucaccgauuuguuugcugcucagccagguuugaccagugcugucauugaggcacuucccaggaauauggugcugaccugucagggaucagacgacaucaaaaaauuguuggauucacaggggagaagggacauuaaacucauugauguuucucucaauaaaauugacucaagaaaguuugagaaugcuguaugggaucaauacaaagaucugugucacaugcauacagggguagucguggagaagaaaaagaagggagggaaagaagaaauaaccccucauugugccuugcuagacugcaucauguuugaugcagccguguccggaggccuaaaugccacaguuuugagagcuguucuaccuagagacaugguguuuagaacgucaucaccuaaagucguucuguaa

SEQ ID NO: 751 - RNA, 1473 nt, Artificial Sequence
  derived and/or modified CDS sequence (opt1) from Lassa virus__AAF86703__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugaucuccuuccuccugcugugcggccgcagcugcuccgugacguacaaggggguguacgagcuccagacccuggagcugaacauggccaaccucaacaugaccaugccgcugagcugcaccaagaacaacucccaccacuacaucauggucggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcgugcaguacaaccucucccacagcuucgcgguggacgccgccaaccacugcgggaccaucgccaacggcguccugcagaccuucaugcggauggcguggggcggguccuacaucgcccuggacagcggcaaggggaacugggacugcaucaugaccuccuaccaguaccucaucauccagaacacgaccugggaggaccacugccaguucagccgccccucccccaucggcuaccuggggcugcucagccagcggacccgcgacaucuacaucagccggcgccugcugggcaccuucacguggacccucuccgacagcgagggcaacgaggcccccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccaucaagcggcucaagacggaggcccagauguccauccagcugaucaacaaggccgugaacgcccugaucaacgaccagcucaucaugaagaaccaccuccgcgacaucaugggcauccccuacugcaacuacagccgguacugguaccugaaccacaccgucaccgggaagaccucccugccccgcugcuggcuggugagcaacggcuccuaccugaacgagacgcacuucagcgacgacaucgagcagcaggcggacaacaugaucaccgagaugcuccagaaggaguacauggaccggcagggcaagaccccgcuggggcugguggaccucuucgucuucuccaccagcuucuaccugaucuccaucuuccugcaccuggugaagaucccgacgcaccgccacaucgugggcaagcccugccccaagccccaccggcucaaccacauggggaucugcagcugcggccuguacaagcacccggggguccccgugaaguggaagcgcuga

SEQ ID NO: 752 - RNA, 1476 nt, Artificial Sequence
  derived and/or modified CDS sequence (opt1) from Lassa virus__AAG41802__GPC
augggccagaucgugaccuucuuccaggaggucccccacgugaucgaggaggugaugaacaucguccugaucgcccucagcauccuggccgugcugaaggggcucuacaacaucgcgaccugcggccugaucgggcugaucacguuccuccugcugugcggccgcuccugcagcuccaaccucuacaaggggguguacgagcugcagagccuggaccucaacauggagacccugaacaugaccaugccgcuguccugcaccaagaacaacagccaccacuacauccgggucggcaacgacacgggccucgagcugacccugaccaacaccuccauccucaaccacaaguucugcaaccugagcgacgcccacaagaaggaccuguacgaccacgcccucauguccaucaucagcacguuccaccuguccauccccaacuucaaccaguacgaggccaugagcugcgacuucaacgggggcaagaucuccgugcaguacaaccugagccacuccuacgccaucgacgcggccaaccacugcgggaccguggccaacggcauccuccagaccuucaugcgcauggccuggggcgggagcuacaucgcgcuggacuccggccgggggaacugggacugcaucaugaccagcuaccaguaccugaucauccagaacacgaccugggagaaccacugccaguucucccgccccagccccaucggcuaccucgggcugcugagccagcggacccgcgacaucuacaucucccggcgccuccugggcaccuucacguggacccugagcgacuccgagggcaacgccacccccgggggcuacugccucacccgguggaugcugaucgaggccgagcugaagugcuucgggaacacggccgucgccaagugcaacgagaagcacgacgaggaguucugcgacaugcuccgccuguucgacuucaacaagcaggcgaucagccggcugaaguccgaggcccagaugagcauccagcucaucaacaaggccgugaacgcccugaucaacgaccagcugaucaugaagaaccaccuccgcgacaucaugggcauccccuacugcaacuacuccaaguacugguaccugaaccacaccaucaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugcgguggaagcgcuga

SEQ ID NO: 753 - RNA, 1473 nt, Artificial Sequence
  derived and/or modified CDS sequence (opt1) from Lassa virus__AAL13212__GPC
augggccagaucgugaccuucuuccaggaggucccccacgugaucgaggagaucaugaacaucgugcugaucacccucagccugcuggccauccucaagggggucuacaaccuggccacgugcggccugaucgggcucaucaccuuccuguuccugugcggccgcuccugcagcaugaccuacaagggguccuaccagcucgagacccuggagcugaacauggagacgcucaacaugaccaugccgcugagcugcaccaagaacaccucccaccacuacauccgggugggcaacgagacgggccuggagcucacccugaccaacaccagcaucaucaaccacaaguucugcaaccuguccgacgcgcacaagaagaaccucuacgaccacagccugauguccaucaucagcacguuccaccuguccauccccaacuucaaccaguacgaggccaugagcugcgacuucaacgggggcaagaucuccauccaguacaaccucagccacaccuacgccggggacgccgccaagcacugcggcacccuggcgaacgggauccugcagaccuucaugcgcauggccuggggcggcuccuacaucgcccucgacagcgggcggggcaacugggacugcaucaugacguccuaccaguaccugaucauccagaacaccaccugggaggaccacugccaguucagccgccccucccccaucggguaccugggccuccugagccagcggacccgcgagaucuacaucagccggcgccugcucggcacguucaccuggacccuguccgacagcgaggggaacgagaacccgggcggguacugccugacccgguggaugcucaucgaggccgagcugaagugcuucggcaacacggcgguggccaagugcaacgagaagcacgacgaggaguucugcgacaugcugcgccucuucgacuucaacaagcaggccauccagcggcugaaggccgaggcccagauguccauccagcugaucaacaaggcggucaacgcccucaucaacgaccagcugaucaugaagaaccaccuccgcgacaucauggggauccccuacugcaacuacagcaaguacugguaccugaaccacaccaccaccggccggacgucccugccccgcugcuggcuggugagcaacggcuccuaccucaacgagacccgguucagcgacgacaucgagcagcaggccgacaacaugaucaccgagaugcugcagaaggaguacaucgaccgccaggggaagacgccccugggccucguggaccuguucgucuucuccaccagcuucuaccugaucuccaucuuccugcaccucaucaagaucccgacccaccggcacaucgucgggggccccugccccaagccccaccgccugaaccacaaggggaucugcagcugcggccuguacaagcggccgggcguguccgugcgcuggaagcgguga

SEQ ID NO: 754 - RNA, 1476 nt, Artificial Sequence
  derived and/or modified CDS sequence (opt1) from Lassa virus__AAO59512__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucgccuuccuccugcugugcggccgcuccugcacgagcucccucuacaaggggguguacgagcugcagacccuggagcucaacauggagacccugaacaugaccaugccgcugagcugcacgaagaacaacucccaccacuacauccgggugggcaacgagaccggccucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgguggacgccgccaagcacugcgggaccguggccaacggcguccugcagaccuucaugcgcauggcguggggcggguccuacaucgcccucgacagcggccacgggcggugggacugcaucaugacguccuaccaguaccugaucauccagaacaccaccugggaggaccacugccaguucagccgccccucccccaucggcuaccuggggcuccugagccagcggacccgcgacaucuacaucagccggcgccugcucggcacguucaccuggacccuguccgacagcgagggcaaggacacccccgggggcuacugccugacgcgguggaugcucaucgaggccgagcugaagugcuucgggaacaccgccguggccaagugcaacgagaagcacgacgaggaguucugcgacaugcugcgccucuucgacuucaacaagcaggcgauccagcggcugaagaccgaggcccagauguccauccagcugaucaacaaggccgugaacgcccucaucaacgaccagcugaucaugaagaaccaccuccgcgacaucaugggcauccccuacugcaacuacagccgguacugguaccugaaccacaccacgaccgggaagaccucccugcccaagugcuggcuggucagcaacggcuccuaccucaacgagacccgcuucagcgacgacaucgagcagcaggccgacaacaugaucacggagaugcugcagaaggaguacauggagcggcagggcaagaccccgcuggggcucguggaccuguucguguucuccaccagcuucuaccugaucuccaucuuccugcaccucgucaagaucccgacccaccgccacaucgugggcaagagcugccccaagccccaccggcugaaccacauggggaucugcuccugcggccuguacaagcagcccggggugccggucaaguggaagcgcuga

SEQ ID NO: 755 - RNA, 1476 nt, Artificial Sequence
  derived and/or modified CDS sequence (opt1) from Lassa virus__AAT49000__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccucuuccugugcggccgcuccugcagcaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacacccugaugagcaucaucuccaccuuccaccugagcauccccaacuucaaccaguacgaggccauguccugcgacuucaacgggggcaagaucagcguccaguacaaccucucccacagcuacgccguggacgccgcgaaccacugcgggacgguggccaacggcguccugcagaccuucaugcggauggccuggggcggguccuacaucgcccuggacagcggccgcgggaacugggacugcaucaugaccuccuaccaguaccucgugauccagaacaccacgugggaggaccacugccaguucagccggcccucccccaucggcuaccuggggcugcucagccagcgcacccgggacaucuacaucagccgccggcugcugggcaccuucaccuggacgcucuccgacagcgagggcaaggacacccccgggggcuacugccugacccgcuggaugcugaucgaggcggagcucaagugcuucgggaacaccgccguggccaagugcaacgagaagcacgacgaggaguucugcgacaugcugcggcuguucgacuucaacaagcaggccauccagcgccucaaggccgaggcgcagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugcccaagugcuggcuggugagcaacggcuccuaccugaacgagacccacuucagcgacgacaucgagcagcaggccgacaaccucaucacggagaugcugcagaaggaguacauggagcgccagggcaagaccccgcuggggcucgucgaccuguucguguucuccaccagcuucuaccugaucuccaucuuccugcaccucgugaagaucccgacccaccggcacaucgucggcaagcccugccccaagccccaccgccugaaccacauggggaucugcagcugcggcguguacaagcagccgggggugcccguccgguggaagcgcuga

SEQ ID NO: 756 - RNA, 1476 nt, Artificial Sequence
  derived and/or modified CDS sequence (opt1) from Lassa virus__AAT49004__GPC
augggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcuga

SEQ ID NO: 757 - RNA, 1476 nt, Artificial Sequence
  derived and/or modified CDS sequence (opt1) from Lassa virus__AAT49008__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccucuuccugugcggccgcuccugcagcaccacccuguacaaggggguguacgagcuccagacccuggagcugaacauggagacgcucaacaugaccaugccgcuguccugcaccaagaacaacagccaccacuacaucauggugggcaacgagaccggccuggagcucacgcugaccaacaccuccaucaucaaccacaaguucugcaaccugagcgacgcccacaagaagaaccucuacgaccacacccugauguccaucaucagcacguuccaccuguccauccccaacuucaaccaguacgaggccaugagcugcgacuucaacgggggcaagaucuccguccaguacaaccucagccacuccuacgccguggacgccgcgaaccacugcgggaccguggccaacggcguccugcagaccuucaugcggauggccuggggcgggagcuacaucgcccuggacuccggccgcgggaacugggacugcaucaugaccagcuaccaguaccucaucauccagaacacgaccugggaggaccacugccaguucucccggcccagccccaucggcuaccuggggcugcucucccagcgcacccgggacaucuacaucagccgccggcugcugggcaccuucacguggacccucagcgacuccgagggcaaggacacccccgggggcuacugccugacccgcuggaugcugaucgaggcggagcucaagugcuucgggaacacggccguggccaagugcaacgagaagcacgacgaggaguucugcgacaugcugcggcuguucgacuucaacaagcaggccauccagcgccucaaggccgaggcgcagaugagcauccagcugaucaacaaggccgugaacgcccugaucaacgaccagcucaucaugaagaaccaccuccgggacaucaugggcauccccuacugcaacuacucccgcuacugguaccugaaccacaccgucaccgggaagaccagccugcccaagugcuggcugguguccaacggcagcuaccugaacgagacgcacuucuccgacgacaucgagcagcaggccgacaaccucaucaccgagaugcugcagaaggaguacauggagcggcagggcaagaccccgcuggggcucguggaccuguucgucuucagcaccuccuucuaccugaucagcaucuuccugcaccucgugaagaucccgacgcaccgccacaucgugggcaagcccugccccaagccccaccggcugaaccacauggggaucugcuccugcggcgucuacaagcagccgggggugcccgugcgcuggaagcgguga

SEQ ID NO: 758 - RNA, 1473 nt, Artificial Sequence
  derived and/or modified CDS sequence (opt1) from Lassa virus__AAT49010__GPC
augggccagaucgugaccuucuuccaggaggucccccacgugaucgaggaggugaugaacaucguccugaucgcccucagcgugcuggccauccugaaggggcucuacaacuucgcgaccugcggccugaucgggcuggugacguuccuccugcuguccggccgcagcugcuccaugaucuacaagggggucuacgagcuccagacccuggagcugaacauggagacccucaacaugaccaugccgcugagcugcacgaagaacaccucccaccacuacauccgggugggcaacgacaccggccuggagcucacccugacgaacgagacccugcuccaccacaaguucugcaaccugagcgacgcccacaagcgcaaccuguacgaccacgcccucauguccaucaucagcaccuuccaccuguccauccccaacuucaaccaguacgaggccaugagcugcgacuucaacgggggcaagaucaccgugcaguacaaccugucccacagcuacgccgucgacgcggccaagcacugcgggacgguggccaacggcgugcuccagaccuucaugcggauggccuggggcggguccuacaucgcgcuggacagccgccacggcaacugggacugcaucaugaccuccuaccaguaccugaucauccagaacaccacgugggaggaccacugccaguucagccggcccucccccaucggguaccucggccugcugagccagcgcacccgggacaucuacaucucccgccggcuccuggggaccuucaccuggacgcugagcgacagcgagggcaacgagaccccgggcggguacugccucacccgcuggaugcugaucgaggccgagcugaagugcuucggcaacaccgccgucgccaagugcaacgagaagcacgacgaggaguucugcgacaugcuccggcuguucgacuucaacaagcaggccauccgccggcugaagacggaggcgcagauguccauccagcucaucaacaaggccgugaacgcccugaucaacgaccagcugaucaugaagaaccaccuccgcgacaucauggggauccccuacugcaacuacagcaaguacugguaccugaaccacaccuccaccggcaagaccagccugccccggugcuggcucguguccaacgggagcuaccugaacgagacgcacuucuccgacgacaucgagcagcaggccgacaacaugaucaccgagaugcugcagaaggaguaccucgaccgccagggcaagacgccccugggccuggucgaccuguucguguucagcaccuccuucuaccucaucagcaucuuccugcaccugaucaagaucccgacccaccggcacaucguggggaagcccugccccaagccccaccgccucaaccacaugggcaucugcuccugcgggcuguacaagcagccgggcguccccgugcgguggaagcgcuga

SEQ ID NO: 759 - RNA, 1473 nt, Artificial Sequence
  derived and/or modified CDS sequence (opt1) from Lassa virus__AAT49014__GPC
augggccagaucaucaccuucuuccaggaggugccccacgucaucgaggaggugaugaacaucgugcugaucgcccucagccugcuggccauccucaaggggcuguacaacaucgcgaccugcggcaucaucgggcuggucgccuuccucuuccugugcggcaaguccugcagccugacgcucaagggcggguacgagcugcagacccuggagcucaacauggagacccugaacaugaccaugccgcuguccugcacgaagaacagcucccaccacuacauccgcgugggcaacgagaccgggcucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacggcgggaagaucagcgugcaguacaaccugucccacagcuacgcgggcgacgccgccgagcacugcgggaccgucgccaacggcgugcugcagaccuucaugcggauggcguggggcgggcgcuacaucgcccucgacuccggcaaggggaacugggacugcaucaugacgagcuaccaguaccugaucauccagaacaccaccugggaggaccacugccaguucucccggcccagccccaucggcuaccugggccuccugucccagcgcacccgggacaucuacaucagccgccggcugcucgggacguucaccuggacccugagcgacuccgagggcaacgagacccccgggggcuacugccugacgcgcuggaugcucaucgaggccgagcugaagugcuucgggaacaccgccguggccaagugcaacgagaagcacgacgaggaguucugcgacaugcugcggcuguucgacuucaacaagcaggcgauccgccggcugaaggccgaggcccagaugagcauccagcugaucaacaaggccgucaacgcccucaucaacgaccagcugaucaugaagaaccaccuccgcgacaucaugggcauccccuacugcaacuacuccaaguacugguaccucaaccacaccagcuccggccggaccagccugcccaagugcuggcugaucuccaacgggagcuaccucaacgagacgcaguucuccgacgacaucgagcagcaggcggaccacaugaucaccgagaugcugcagaaggaguacaucgagcgccagggcaagaccccgcuggggcucguggacaucuucaucuucagcaccuccuucuaccugaucagcaucuuccugcaccugaucaagaucccgacgcaccggcacaucgugggcaagcccugccccaagccccaccgccucaaccacaugggggucugcuccugcggccuguacaagcacccgggcgugcccaccaaguggaagcgguga

SEQ ID NO: 760 - RNA, 1476 nt, Artificial Sequence
  derived and/or modified CDS sequence (opt1) from Lassa virus__AAV54104__GPC
augggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgagggggaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcuga

SEQ ID NO: 761 - RNA, 1476 nt, Artificial Sequence
  derived and/or modified CDS sequence (opt1) from Lassa virus__ADI39451__GPC
augggccagaucgugaccuucuuccaggaggucccccacgugaucgaggaggugaugaacaucguccugaucgcccucagcgugcuggccgugcugaaggggcucuacaacgucgcgaccugcggccugaucgggcugaucgccuuccuccugcugugcggccgcuccugcacgaccacccucuacaaggggguguacgagcugcaggcccuggagcucaacauggagacccugaacaugacgaugccgcugagcugcaccaagaacaacucccaccacuacaucauggugggcaacgagaccggccucgagcugacccugacgaacaccagcaucaucaaccacaaguucugcaaccucuccgacgcccacaagaagaaccuguacgaccacgcccugaugagcaucaucuccaccuuccaccucagcauccccaacuucaaccaguacgaggcgauguccugcgacuucaacgggggcaagaucagcguccaguacaaccugucccacaccuacgccguggacgccgccaaccacugcgggacgguggcgaacggcguccugcagaccuucaugcggauggccuggggcgggagcuacaucgcccucgacuccggccgcgggagcugggacugcaucaugaccuccuaccaguaccugaucauccagaacaccacgugggaggaccacugccaguucagccggcccucccccaucggcuaccuggggcuccugagccagcgcacccgggacaucuacaucucccgccggcugcucggcaccuucaccuggacgcugagcgacagcgagggcaaggacacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgccugaaggccgaggcccagauguccauccagcugaucaacaaggccgugaacgcgcucaucaacgaccagcugaucaugaagaaccaccuccgggacaucaugggcauccccuacugcaacuacagcaaguacugguaccucaaccacacgaucaccgggcgcaccucccugcccaagugcuggcuggucagcaacggcuccuaccucaacgagacccacuucagcgacgacaucgagcagcaggccgacaacaugaucacggagaugcugcagaaggaguacaucgagcggcagggcaagaccccgcuggggcucguggaccuguucguguucuccaccagcuucuaccugaucuccaucuuccugcaccucaucaagaucccgacccaccgccacaucgucaacaagcccugccccaagccccaccggcugaaccacaugggcgugugcagcugcgggcuguacaagcagccgggcgugcccguccgcuggaagcgguga

SEQ ID NO: 762 - RNA, 1473 nt, Artificial Sequence
  derived and/or modified CDS sequence (opt1) from Lassa virus__ADU56610__GPC
augggccagaucgugaccuucuuccaggaggucccccacgugaucgaggaggugaugaacaucguccugaucgcccucagccugcuggccauccucaaggggaucuacaacguggcgaccugcggccuguucgggcugaucuccuuccuccugcugugcggccgcagcugcuccacgaccuacaaggggguguacgagcuccagacccuggagcuggacauggccaaccucaacaugaccaugccgcugagcugcacgaagaacuccagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaaggggaacugggacugcaucaugacguccuaccaguaccucaucauccagaacaccaccugggaggaccacugccaguucagccgccccucccccaucggcuaccuggggcugcucagccagcggacccgcgacaucuacaucagccggcgccugcugggcacguucaccuggacccucuccgacagcgagggcaacgaggcccccgggggcuacugccugacccgguggaugcugaucgaggccgagcucaagugcuucgggaacacggcgaucgccaagugcaacgagaagcacgacgaggaguucugcgacaugcugcgccuguucgacuucaacaagcaggccaucaagcggcucaaggccgaggcccagauguccauccagcugaucaacaaggcggugaacgcccugaucaacgaccagcucaucaugaagaaccaccuccgcgacaucaugggcauccccuacugcaacuacagcaaguacugguaccugaaccacaccgugaccgggaagaccucccugccccggugcuggcugaucagcaacggcuccuaccugaacgagacgcacuucagcgacgacaucgagcagcaggccgacaacaugaucaccgagcuccugcagaaggaguacauggaccgccagggcaagaccccgcuggggcucgucgaccuguucguguucuccaccagcuucuaccugaucuccaucuuccugcaccucgugaagaucccgacgcaccggcacaucgucggccgccccugccccaagccccaccggcugaaccacauggggaucugcagcugcggccuguacaagcacccgggggugcccgugaaguggaagcgcuga

SEQ ID NO: 763 - RNA, 1473 nt, Artificial Sequence
  derived and/or modified CDS sequence (opt1) from Lassa virus__ADU56618__GPC
augggccagaucgugaccuucuuccaggaggucccccacgugaucgaggaggugaugaacaucguccugaucgcccucagcauccuggccauccugaaggggcucuacaacaucgcgaccugcggccugaucgggcuggugacguuccuccugcuguccggccgcagcugcuccaugaccuacaaggggguguacgagcuccagacccuggagcugaacaugaacacccucaacaugacgaugccgcugagcugcaccaagaacaacucccaccacuacaucauggucggcaacgagaccggccuggagcucacccugacgaacaccagccugcuccaccacaaguucugcaaccuguccgacgcccacaagaagaaccuguacgaccacacccucaugagcaucaucuccaccuuccaccugagcauccccaacuucaaccaguacgaggccauguccugcgacuucaacgggggcaagaucacggugcaguacaaccugagccacuccuacgccaucgacgccgcgaaccacugcgggaccguggccaacggcguccuccagaccuucaugcggauggccuggggcgggagcuacaucgcccuggacuccggccgcgggaagugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgagacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccgccggcugaaggccgaggcgcagaugagcauccagcucaucaacaaggccgugaacgcccugaucaacgaccagcugaucaugaagaaccaccuccgcgacaucaugggcauccccuacugcaacuacuccaaguacugguaccugaaccacaccagcaccgggcggaccucccugccccgcugcuggcucgucagcaacggcuccuaccugaacgagacgcacuucagcgacgacaucgagcagcaggccgacaacaugaucaccgagaugcugcagaaggaguaccucgaccggcagggcaagaccccgcuggggcugguggaccuguucguguucuccaccagcuucuaccucaucuccaucuuccugcaccuggucaagaucccgacgcaccgccacaucgugggcaagcccugccccaagccccaccggcucaaccacauggggaucugcagcugcggccuguacaagcagccgggggugcccguccgcuggaagcgguga

SEQ ID NO: 764 - RNA, 1473 nt, Artificial Sequence
  derived and/or modified CDS sequence (opt1) from Lassa virus__ADU56622__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcuga

SEQ ID NO: 765 - RNA, 1473 nt, Artificial Sequence
  derived and/or modified CDS sequence (opt1) from Lassa virus__ADU56626__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcugaacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccgucacggggaagaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcgguga

SEQ ID NO: 766 - RNA, 1473 nt, Artificial Sequence
  derived and/or modified CDS sequence (opt1) from Lassa virus__ADU56630__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugcgcaucccgacccaccggcacgugaucggcaagcccugccccaagccccaccgccugaaccacauggggaucugcuccugcggccuguacaagcacccggggguccccgugaaguggaagcgguga

SEQ ID NO: 767 - RNA, 1476 nt, Artificial Sequence
  derived and/or modified CDS sequence (opt1) from Lassa virus__AFY05588__GPC
augggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggaccuguacaucagccgccggcuccugggcaccuucaccuggacgcugagcgacuccgagggggaggacaccccgggcggguacugccucacccgcuggaugcugaucgaggccgagcugaagugcuucggcaacaccgccguggccaagugcaacgagaagcacgacgaggaguucugcgacaugcuccggcuguucgacuucaacaagcaggccauccagcgccugaaggcggaggcccagaugagcauccagcucaucaacaaggccgugaacgcccugaucaacgaccagcugaucaugaagaaccaccuccgggacaucauggggauccccuacugcaacuacuccaaguacugguaccugaaccacacgaccaccggccgcaccagccugcccaagugcuggcucgucuccaacggcagcuaccugaacgagacgcacuucuccgacgacaucgagcagcaggccgacaacaugaucaccgagaugcugcagaaggaguacauggagcggcaggggaagacgccccucggccugguggaccuguucguguucagcaccuccuucuaccugaucagcaucuuccuccaccuggucaagaucccgacccaccgccacaucguggggaaguccugccccaagccccaccggcugaaccacaugggcaucugcagcugcgggcucuacaagcagcccggcgugccggucaaguggaagcgcuga

SEQ ID NO: 768 - RNA, 1476 nt, Artificial Sequence
  derived and/or modified CDS sequence (opt1) from Lassa virus__AFY05590__GPC
augggccagaucgugaccuucuuccaggaggucccccacgugaucgaggaggugaugaacaucguccugaucgcccucagcgugcuggccgugcugaaggggcucuacaacuucgcgaccugcggccuggucgggcuggugacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggucggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacgguggccaacgggguccugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacauguacaucagccgccggcugcucggcaccuucaccuggacgcugagcgacuccgagggggaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggccgcaccagccugcccaagugcuggcuggucuccaacggcagcuaccucaacgagacgcacuucuccgacgacaucgagcagcaggccgacaacaugaucaccgagaugcugcagaaggaguacauggagcggcaggggaagacgccccugggccucguggaccuguucguguucagcaccuccuucuaccugaucagcaucuuccugcaccucgucaagaucccgacccaccgccacaucguggggaaguccugccccaagccccaccggcugaaccacaugggcaucugcagcugcgggcuguacaagcagcccggcgugccggucaaguggaagcgcuga

SEQ ID NO: 769 - RNA, 1476 nt, Artificial Sequence
  derived and/or modified CDS sequence (opt1) from Lassa virus__AHC95553__GPC
augggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguucuuccuccugugcggccgcuccugcagcuccaaccuguacaagggggucuacgagcuccagagccuggaccugaacauggagacccucaacaugaccaugccgcuguccugcaccaagaacaacagccaccacuacauccgggugggcaacgagacgggccuggagcucacccugaccaacaccucccugcucgaccacaaguucugcaaccugagcgacgcccacaagaagaaccuguacgaccacgcccucauguccaucaucagcacguuccaccuguccauccccaacuucaaccaguacgaggccaugagcugcgacuucaacgggggcaagaucaccgugcaguacaaccugucccacagcuacgccggggacgcggcccgccacugcggcaccaucgccaacgggguccuccagaccuucaugcggauggccuggggcggcuccuacaucgcgcuggacagcgggcacggcaacugggacugcaucaugacguccuaccaguaccugaucauccagaacaccaccugggaggaccacugccaguucagccgccccucccccaucggguaccucagccugcugagccagcggacccgcgacaucuacaucucccggcgccuccugggcacguucaccuggacccugagcgacuccgagggcaacgccacccccgggggcuacugccucacgcgguggaugcugaucgaggccgagcugaagugcuucgggaacaccgccguggccaagugcaacgagaagcacgacgaggaguucugcgacaugcuccgccuguucgacuucaacaagcaggcgaucagccggcugcgcuccgaggcccagaugagcauccagcucaucaacaaggccgugaacgcccugaucaacgaccagcugaucaugaagaaccaccuccgggacaucaugggcauccccuacugcaacuacuccaaguacugguaccugaaccacaccgucaccgggcgcacgagccugcccaagugcuggcucguguccaacggcagcuaccugaacgagacccacuucuccgacgacaucgagcagcaggccgacaacaugaucaccgagaugcugcagaaggaguacauggaccggcagggcaagaccccgcucgggcugguggaccuguucgucuucagcacguccuucuaccugaucagcaucuuccuccaccuggugaagaucccgacccaccgccacaucgugggcaagcccugccccaagccccaccggcugaaccgcauggggaucugcuccugcggccucuacaagcagccggggguccccgugaaguggaagcgguga

SEQ ID NO: 770 - RNA, 1476 nt, Artificial Sequence
  derived and/or modified CDS sequence (opt1) from Lassa virus__AHC95555__GPC
augggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguuccuccugcugugcggccgcuccugcagcuccaaccucuacaagggggucuacgagcugcagagccuggaccucaacauggagacccugaacaugaccaugccgcuguccugcaccaagaacaacagccaccacuacauccgggccggcaacgagacgggccucgagcugacccugaccaacaccucccucaucaaccacaaguucugcaaccugagcgacgcccacaagaagaaccuguacgaccacacgcucauguccaucaucagcaccuuccaccuguccauccccaacuucaaccaguacgaggccaugagcugcgacuucaacgggggcaagaucuccgugcaguacaaccugagccacgccuacgcgaucgacgccgccgagcacugcgggaccguggccaacggcguccuccagaccuucaugcgcauggcguggggcggguccuacaucgcccuggacagcggccgggggaacugggacugcaucaugacguccuaccaguaccugaucauccagaacaccaccugggaggaccacugccaguucagccgccccucccccaucggcuaccucgggcugcugagccagcggacccgcgacaucuacaucagccggcgccuccugggcacguucaccuggacccuguccgacagcgagggcaacgccacccccgggggcuacugccucacgcgguggaugcugaucgaggccgagcugaagugcuucgggaacaccgccguggcgaagugcaacgagaagcacgacgaggaguucugcgacaugcuccgccuguucgacuucaacaagcaggccaucucccggcucaagagcgaggcccagauguccauccagcugaucaacaaggccgugaacgcccugaucaacgaccagcugaucaugaagaaccaccuccgcgacaucaugggcauccccuacugcaacuacagcaaguacugguaccugaaccacaccaucaccgggcggacgucccugcccaagugcuggcucgucagcaacggcuccuaccugaacgagacccacuucagcgacgacaucgagcagcaggcggacaacaugaucaccgagaugcugcagaaggaguacauggagcgccagggcaagaccccgcucgggcugguggaccuguucguguucuccacgagcuucuaccugaucuccaucuuccuccaccuggucaagaucccgacccaccggcacaucgugggcaagcccugccccaagccccaccgccugaaccacauggggaucugcagcugcggccucuacaagcagccgggggugccccugaaguggaagcgguga

SEQ ID NO: 771 - RNA, 1476 nt, Artificial Sequence
  derived and/or modified CDS sequence (opt1) from Lassa virus__AHC95557__GPC
augggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguucuuccuccugugcggccgcuccugcagcuccaaccuguacaagggggucuacgagcuccagagccuggaccugaacauggagacccucaacaugaccaugccgcuguccugcaccaagaacaacagccaccacuacauccgggugggcaacgagacgggccuggagcucacccugaccaacaccucccugcucaaccacaaguucugcaaccugagcgacgcccacaagcgcaaccuguacgaccacgcccucauguccaucaucagcacguuccaccuguccauccccaacuucaaccaguacgaggccaugagcugcgacuucaacgggggcaagaucaccgugcaguacaaccugucccacagcuacgccggggacaccgcgaagcacugcggcaccaucgccaacgggguccuccagacguucaugcggauggccuggggcggcuccuacaucgcccuggacagcgggcacggcaacugggacugcaucaugaccuccuaccaguaccugaucauccagaacaccaccugggaggaccacugccaguucagccgccccucccccaucggguaccucggccugcugagccagcggacgcgcgacaucuacaucagccggcgccuccugggcaccuucaccuggacccuguccgacagcgaggggaacgcgacgccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccaucucccggcugcgcagcgaggcgcagauguccauccagcucaucaacaaggccgugaacgcccugaucaacgaccagcugaucaugaagaaccaccuccgggacaucauggggauccccuacugcaacuacagcaaguacugguaccugaaccacaccgucacgggccgcaccucccugcccaagugcuggcucgugagcaacggcuccuaccugaacgagacccacuucagcgacgacaucgagcagcaggccgacaacaugaucaccgagaugcugcagaaggaguacauggaccggcaggggaagacgccccucggccugguggaccuguucgucuucuccaccagcuucuaccugaucuccaucuuccuccaccuggugaagaucccgacccaccgccacaucguggggaagcccugccccaagccccaccggcugaaccgcaugggcaucugcagcugcgggcucuacaagcagccgggcguccccgugaaguggaagcgguga

SEQ ID NO: 772 - RNA, 1476 nt, Artificial Sequence
  derived and/or modified CDS sequence (opt1) from Lassa virus__AHC95559__GPC
augggccagaucaucaccuucuuccaggaggugccccacgucaucgaggaggugaugaacaucgugcugaucgcccucagcauccuggccguccugaaggggcucuacaacaucgcgaccugcggccugaucgggcuggugacguuccuccugcugugcggccgcuccugcagcuccagccucuacaaggggguguacgagcugcagucccuggaccucaacauggagacccugaacaugaccaugccgcugagcugcaccaagaacaacucccaccacuacauccgggucggcaacgagacgggccucgagcugacccugaccaacaccagccucaucaaccacaaguucugcaaccuguccgacgcccacaagaagaaccuguacgaccacgcccucaugagcaucaucuccacguuccaccugagcauccccaacuucaaccaguacgaggccauguccugcgacuucaacgggggcaagaucagcgugcaguacaaccugucccacgccuacgcgaucgacgccgccagccacugcgggaccguggccaacggcguccuccagaccuucaugcgcauggcguggggcggguccuacaucgcccuggacagcggccacgggaacugggacugcaucaugaccuccuaccaguaccugaucauccagaacacgaccugggaggaccacugccaguucagccggcccagccccaucggcuaccucgggcugcugucccagcgcacccgggacaucuacaucagccgccggcuccugggcaccuucacguggacccuguccgacagcgagggcaacgccacccccgggggcuacugccucacccgcuggaugcugaucgaggccgagcugaagugcuucgggaacacggccguggcgaagugcaacgagaagcacgacgaggaguucugcgacaugcuccggcuguucgacuucaacaagcaggccaucucccgccucaagagcgaggcccagauguccauccagcugaucaacaaggccgugaacgcccugaucaacgaccagcugaucaugaagaaccaccuccgggacaucaugggcauccccuacugcaacuacagcaaguacugguaccugaaccacaccgucaccgggaagaccucccugcccaagugcuggcucgugagcaacggcuccuaccugaacgagacgcacuucagcgacgacaucgagcagcaggcggacaacaugaucaccgagaugcugcagaaggaguacauggagcgccagggcaagaccccgcucgggcugguggaccuguucgucuucuccaccagcuucuaccugaucuccaucuuccuccaccuggugaagaucccgacgcaccggcacaucgugggcaagcccugccccaagccccaccgccugaaccacauggggaucugcagcugcggccucuacaagcagccggggguccccgugaaguggaagcgguga

SEQ ID NO: 773 - RNA, 1476 nt, Artificial Sequence
  derived and/or modified CDS sequence (opt1) from Lassa virus__AIT17126__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcugcucacguuccugcugcucugcggccgcuccugcaccaccgggcuguacaagggcgucuacgagcugcagacccucgagcugaacauggagacgcugaacaugaccaugccgcucagcugcaccaagaacaacucccaccacuacaucauggugggcaacgagaccgggcuggagcugacgcucaccaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacggcgggaagaucagcgugcaguacaaccugucccacagcuacgccggcgacgcggccgaccacugcgggacggucgccaacggcgugcuccagaccuucaugcggauggccuggggcggguccuacaucgcgcuggacagcggccgcgggcggugggacugcaucaugaccuccuaccaguaccugaucauccagaacaccacgugggaggaccacugccaguucagccgccccucccccaucggcuaccucggccugcugagccagcggacccgcgacaucuacaucucccggcgccuccuggggaccuucaccuggacgcugagcgacagcgagggcaaggacacccccgggggcuacugccucacccgguggaugcugaucgaggccgagcugaagugcuucgggaacaccgccguggccaagugcaacgagaagcacgacgaggaguucugcgacaugcuccgccuguucgacuucaacaagcaggccauccagcggcugaaggcggaggcccagauguccauccagcucaucaacaaggccgucaacgcccugaucaacgaccagcuggugaugaagaaccaccuccgcgacaucaugggcauccccuacugcaacuacagccgguacugguaccugaaccacacgaccaccggccgcaccucccugcccaagugcuggcucgugagcaacggguccuaccugaacgagacgcacuucagcgacgacaucgagcagcaggccgacaacaugaucaccgagaugcugcagaaggaguacauggagcggcagggcaagaccccgcucgggcuggucgaccuguucguguucuccaccagcuucuaccugaucuccaucuuccuccaccuggugaagaucccgacgcaccgccacaucgucggcaagagcugccccaagccccaccggcugaaccacauggggaucugcuccugcggccucuacaagcagcccggcgugccggugaaguggaagcgcuga

SEQ ID NO: 774 - RNA, 1476 nt, Artificial Sequence
  derived and/or modified CDS sequence (opt1) from Lassa virus__AIT17130__GPC
augggccagaucgugaccuucuuccaggaggucccccacgugaucgaggaggugaugaacaucguccugaucgcccucagcauccuggccgugcugaaggggcucuacaacuucgcgaccugcggcuucguggggcuggucacguuccugcuccugugcggccgcuccugcaccaccagccuguacaaggggguguacgagcuccagacccuggagcugaacauggagacgcucaacaugaccaugccgcuguccugcaccaagaacaacagccaccacuacauccgggugggcaacgacaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccagccacugcgggacgaucgccaacggcgugcugcagaccuucaugcgcauggccuggggcggguccuacaucgcgcuggacagcggccgggaccgcugggacugcaucaugaccuccuaccaguaccucaucauccagaacaccacgugggaggaccacugccaguucagccggcccucccccaucggguaccugggccugcucagccagcgcacccgggacaucuacaucagccgccggcugcuggggaccuucaccuggacgcucuccgacagcgagggcaaggacaccccgggcggguacugccugacccgcuggaugcugaucgaggccgagcucaagugcuucggcaacaccgccgucgccaagugcaacgagaagcacgacgaggaguucugcgacaugcugcggcuguucgacuucaacaagcaggccauccagcgccucaaggcggaggcccagauguccauccagcugaucaacaaggccgugaacgcccugaucaacgaccagcucaucaugaagaaccaccuccgggacaucauggggauccccuacugcaacuacagcaaguacugguaccugaaccacacgaccaccggcaagaccucccugcccaagugcuggcuggugagcaacggguccuaccugaacgagacgcacuucagcgacgacaucgagcagcaggccgacaacaugaucaccgagaugcuccagaaggaguacauggagcgccagggcaagacgccccugggccuggucgaccucuucguguucuccaccagcuucuaccugaucuccaucuuccugcaccuggugaagaucccgacccaccggcacaucgucggcaagagcugccccaagccccaccgccucaaccacauggggaucugcuccugcgggcuguacaagcagcccggcgugccggugaaguggaagcgguga

SEQ ID NO: 775 - RNA, 1476 nt, Artificial Sequence
  derived and/or modified CDS sequence (opt1) from Lassa virus__AIT17134__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcgggcuguacaagcagcccggcgugccggugaaguggaagcgcuga

SEQ ID NO: 776 - RNA, 1476 nt, Artificial Sequence
  derived and/or modified CDS sequence (opt1) from Lassa virus__AIT17138__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccucccugaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccagccacugcgggacgguggccaacggcguccugcagaccuucaugcggauggccuggggcggguccuacaucgcgcuggacagcggccgcgggggcugggacugcaucaugaccuccuaccaguaccucaucauccagaacaccacgugggaggaccacugccaguucagccggcccucccccaucggguaccugggccugcucagccagcgcacccgggacaucuacaucagccgccggcugcugggcaccuucaccuggacgcucuccgacagcgaggggaaggacaccccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggccauccagcgccucaaggcggaggcccagauguccauccagcugaucaacaaggccgugaacgcccugaucaacgaccagcucaucaugaagaaccaccuccgggacaucauggggauccccuacugcaacuacagcaaguacugguaccugaaccacacgaccaccggccgcaccucccugccccggugcuggcuggucagcaacggcuccuaccugaacgagacgcacuucagcgacgacaucgagcagcaggccgacaacaugaucaccgagaugcuccagaaggaguacauggagcgccaggggaagacgccccugggccugguggaccuguucguguucuccaccagcuucuaccucaucuccaucuuccugcaccuggucaagaucccgacccaccggcacaucgugggcaagagcugccccaagccccaccgccucaaccacauggggaucugcuccugcgggcuguacaagcagcccggcgugccggucaaguggaagcgguga

SEQ ID NO: 777 - RNA, 1476 nt, Artificial Sequence
  derived and/or modified CDS sequence (opt1) from Lassa virus__AIT17142__GPC
augggccagaucgugaccuucuuccaggaggucccccacgugaucgaggaggugaugaacaucguccugaucgcccucagcgugcuggccgugcugaaggggcucuacaacuucgcgaccugcggcaucgucgggcuggugacguuccugcuccugugcggccgcuccugcaccaccagccuguacaaggggguguacgagcuccagacccuggagcugaacauggagacgcucaacaugaccaugccgcuguccugcaccaagaacaacagccaccacuacaucauggucggcaacgacaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacuccuacgccggggacgcggccgaccacugcggcacgguggccaacgggguccugcagaccuucaugcggauggccuggggcggcagcuacaucgcgcuggacuccgggcgcggccggugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugcccaagugcuggcuggucuccaacggcagcuaccugaacgagacgcacuucuccgacgacaucgagcagcaggccgacaacaugaucaccgagaugcuccagaaggaguacauggagcggcaggggaagacgccccugggccugguggaccucuucguguucagcaccuccuucuaccugaucagcaucuuccugcaccuggucaagaucccgacccaccgccacaucguggggaagcccugccccaagccccaccggcucaaccacaugggcaucugcuccugcgggcuguacaagcagccgggcgugcccgucaaguggaagcgcuga

SEQ ID NO: 778 - RNA, 1476 nt, Artificial Sequence
  derived and/or modified CDS sequence (opt1) from Lassa virus__AIT17146__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggccggugggacugcaucaugaccagcuaccaguaccugaucauccagaacaccacgugggaggaccacugcuccuucagccgccccucccccaucggguaccucggccugcugagccagcggacccgcgacaucuacaucagccggcgccuccugggcaccuucaccuggacgcuguccgacagcgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagauguccauccagcucaucaacaaggccgugaacgcccugaucaacgaccagcugaucaugaagaaccaccuccgcgacaucauggggauccccuacugcaacuacagcaaguacugguaccugaaccacacgaccaccggcaagaccucccugcccaagugcuggcucgugagcaacggcuccuaccugaacgagacgcacuucagcgacgacaucgagcagcaggccgacaacaugaucaccgagaugcugcagaaggaguacauggagcggcaggggaagacgccccucggccuggucgaccuguucguguucuccaccagcuucuaccugaucuccaucuuccuccaccuggugaagaucccgacccaccgccacaucgucggcaagagcugccccaagccccaccggcugaaccacauggggaucugcuccugcggguucuacaagcagcccggcgugccggugaaguggaagcgcuga

SEQ ID NO: 779 - RNA, 1476 nt, Artificial Sequence
  derived and/or modified CDS sequence (opt1) from Lassa virus__AIT17154__GPC
augggccagaucgugaccuucuuccaggaggucccccacgugaucgaggaggugaugaacaucguccugaucgcccucagcauccuggccgugcugaaggggcucuacaacuucgcgaccugcggcaucguggggcuggucuccuuccugcuccugugcggccgcagcugcacgaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacagcuacgccggggacgcggccaaccacugcggcaccaucgccaacggggugcugcagacguucaugcggauggccuggggcggcuccuacaucgcgcuggacagcgggcgcgaccggugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaaggacacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccagcggcucaaggcggaggcccagauguccauccagcugaucaacaaggccgucaacgcccugaucaacgaccagcucaucaugaagaaccaccuccgcgacaucaugggcauccccuacugcaacuacagcaaguacugguaccugaaccacaccacgaccgggaagaccucccugcccaagugcuggcuggugagcaacggcuccuaccugaacgagacccacuucagcgacgacaucgagcagcaggccgacaacaugaucacggagaugcuccagaaggaguacauggagcggcagggcaagaccccgcuggggcugguggaccucuucgucuucuccaccagcuucuaccugaucuccaucuuccugcaccuggugaagaucccgacccaccgccacguggucggcaagagcugccccaagccccaccggcucaaccacauggggaucugcuccugcggccuguacgggcagcccggcgugccggugaaguggaagcgcuga

SEQ ID NO: 780 - RNA, 1476 nt, Artificial Sequence
  derived and/or modified CDS sequence (opt1) from Lassa virus__AIT17158__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaaguccugccccaagccccaccggcugaaccacauggggaucugcagcugcggccuguacaagcagcccggggugccggugaaguggaagcgcuga

SEQ ID NO: 781 - RNA, 1476 nt, Artificial Sequence
  derived and/or modified CDS sequence (opt1) from Lassa virus__AIT17164__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccagcucccucuacaaggggguguacgagcugcagacccuggagcucaacauggagacccugaacaugacgaugccgcugagcugcaccaagaacaacucccaccacuacauccgggugggcaacgagaccggccucgagcugacccugacgaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgccggggacgcggccaagcacugcggcaccguggccaacggggugcugcagacguucaugcgcauggccuggggcggcuccuacaucgcgcucgacagcgggcacggcaacugggacugcaucaugaccuccuaccaguaccugaucauccagaacaccaccugggaggaccacugccaguucagccggcccucccccaucggguaccugggccuccugagccagcgcacgcgggacaucuacaucagccgccggcugcucggcaccuucaccuggacccuguccgacagcgaggggaacgacgccccgggcggguacugccugacgcgcuggaugcucauccaggccgagcugaagugcuucggcaacaccgccgucgccaagugcaacgagaagcacgacgaggaguucugcgacaugcugcggcuguucgacuucaacaagcaggcgauccagcgccugaaggccgaggcccagauguccauccagcugaucaacaaggccgugaacgcccucaucaacgaccagcugaucaugaagaaccaccuccgggacaucauggggauccccuacugcaacuacagcaaguacugguaccucaaccacaccaccacgggccgcaccucccugccccggugcuggcuggugagcaacggcuccuaccucaacgagacccacuucagcgacgacaucgagcagcaggcggacaacaugaucaccgagaugcugcagaaggaguacauggagcgccaggggaagacgccccugggccucgucgaccuguucguguucuccaccagcuucuaccugaucuccaucuuccugcaccucgugaagaucccgacccaccggcacaucgucggcaagagcugccccaagccccaccgccugaaccacauggggaucugcuccugcgggcuguucaagcagcccggcgugccggugaaguggaagcgguga

SEQ ID NO: 782 - RNA, 1476 nt, Artificial Sequence
  derived and/or modified CDS sequence (opt1) from Lassa virus__AIT17168__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcugcucaccuuccugcugcucugcggccgcuccugcaccgccagccgguacaagggggucuacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgcgggggacgccgccaaccacugcggcaccgucgccaacggggugcugcagacguucaugcgcauggcguggggcggcagcuacaucgcccucgacuccgggcacggcagcugggacugcaucaugaccuccuaccaguaccugaucauccagaacaccaccugggaggaccacugccaguucagccggcccucccccaucggguaccugggccuccugagccagcgcacgcgggacaucuacaucagccgccggcugcucggcaccuucaccuggacccuguccgacagcgaggggaaggacacgccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggcgauccagcgccugaaggccgaggcccagauguccauccagcugaucaacaaggccgucaacgcccucaucaacgaccagcugaucaugaagaaccaccuccgggacaucauggggauccccuacugcaacuacagcaaguacugguaccucaaccacaccacgaccggcaagaccucccugcccaagugcuggcuggugagcaacggcuccuaccucaacgagacccacuucagcgacgacaucgagcagcaggcggacaacaugaucacggagaugcugcagaaggaguacauggagcgccaggggaagacgccccugggccucguggaccuguucgucuucuccaccagcuucuaccugaucuccaucuuccugcaccucgugaagaucccgacccaccggcacaucgugggcaagagcugccccaagccccaccgccugaaccacauggggaucugcuccugcgggcuguacaagcagcccggcgucccggugaaguggaagcgguga

SEQ ID NO: 783 - RNA, 1476 nt, Artificial Sequence
  derived and/or modified CDS sequence (opt1) from Lassa virus__AIT17172__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaagcccugcccccggccccaccgccugaaccacaugggcaucugcuccugcgggcuguacaagcagccgggcgugcccgugaaguggaagcgguga

SEQ ID NO: 784 - RNA, 1476 nt, Artificial Sequence
  derived and/or modified CDS sequence (opt1) from Lassa virus__AIT17176__GPC
augggccagaucgugaccuucuuccaggaggucccccacgugaucgaggaggugaugaacaucguccugaucgcccucagccugcuggccgugcucaaggggcuguacaacguggcgaccugcggccugaucgggcucaucacguuccugcugcucugcggccgcuccugcaccaccaaccuguacaagggggucuacgagcugcaggcccucgagcugaacauggagacccugaacaugacgaugccgcucagcugcaccaagaacaacucccaccacuacaucauggugggcaacgagaccggccuggagcugacccucacgaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgggggccggaucagcgugcaguacaaccugucccacagcuacgcgggggacgccgccucccacugcggcaccaucgccaacgggguccuccagacguucaugcgcauggcguggggcggcagcuacaucgcccuggacuccgggcacggcgggugggacugcaucaugaccagcuaccaguaccugaucauccagaacaccaccugggaggaccacugccaguucucccggcccagccccaucggcuaccucggccugcugucccagcgcacgcgggacaucuacaucagccgccggcuccuggggaccuucaccuggacccugagcgacuccgagggcaaggacacgcccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggcgauccagcgccugaaggccgaggcccagaugagcauccagcucaucaacaaggccgugaacgcccugaucaacgaccagcugaucaugaagaaccaccuccgggacaucaugggcaucccguacugcaacuacuccaaguacugguaccugaaccacaccgucacgggcaagaccagccugcccaagugcuggcucguguccaacgggagcuaccugaacgagacccacuucuccgacgacaucgagcagcaggcggacaacaugaucaccgagaugcugcagaaggaguacauggagcgccagggcaagacgccccucgggcugguggaccuguucgucuucagcaccuccuucuaccugaucagcaucuuccuccaccuggugaagaucccgacccaccggcacguggucggcaagcccugccccaagccccaccgccugaaccacauggggaucugcuccugcggccucuacaagcagccgggcgugcccgugcgguggaagcgcuga

SEQ ID NO: 785 - RNA, 1476 nt, Artificial Sequence
  derived and/or modified CDS sequence (opt1) from Lassa virus__AIT17180__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcagacgcuggagcucaacauggagacccugaacaugaccaugccgcugagcugcaccaagaacaacucccaccacuacauccgggugggcaacgagacgggccucgagcugacccugaccaacaccagcaucaucaaccacaaguucugcaaccucuccgacgcccacaagaagaaccuguacgaccacgcccugaugagcaucaucuccacguuccaccucagcauccccaacuucaaccaguacgaggccauguccugcgacuucaacgggggcaagaucagcguccaguacaaccugucccacagcuacgccggggacgcggccaaccacugcggcaccguggccaacggggugcugcagaccuucaugcgcauggccuggggcggcuccuacaucgcgcucgacagcgggcggggcaacugggacugcaucaugaccuccuaccaguaccugaucauccagaacacgaccugggacgaccacugccaguucagccgccccucccccaucggguaccugggccuccugagccagcggacccgcgacgucuacaucucccggcgccugcucggcaccuucacguggacccugagcgacagcgaggggaaggacaccccgggcggguacugccugacccgguggaugcucaucgaggccgagcugaagugcuucggcaacacggccguggccaagugcaacgagaagcacgacgaggaguucugcgacaugcugcgccucuucgacuucaacaagcaggccauccagcggcugaaggcggaggcccagauguccauccagcugaucaacaaggccgugaacgcccucaucaacgaccagcugaucaugaagaaccaccuccgcgacaucauggggauccccuacugcaacuacagcaaguacugguaccugaacaacaccgccaccggcaagaccucccugcccaagugcuggcugaucagcaacggcuccuaccucaacgagacgcacuucagcgacgacaucgagcaggaggcggacaacaugaucaccgagaugcugcagaaggaguacauggagcggcaggggaagacgccccugggccucgucgaccuguucguguucuccaccagcuucuaccugaucuccaucuuccugcaccucgugaagaucccgacccaccgccacaucgucggcaagagcugccccaagccccaccggcugaaccacauggggaucugcuccugcgggcuguacaagcagcccggcgugccggugcgcuggaagcgguga

SEQ ID NO: 786 - RNA, 1476 nt, Artificial Sequence
  derived and/or modified CDS sequence (opt1) from Lassa virus__AIT17184__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucaccuuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgggggacgccgccaaccacugcggcacgguggccaacggggugcugcagaccuucaugcgcauggcguggggcggcuccuacaucgcccucgacagcgggcggaacggcugggacugcaucaugaccuccuaccaguaccugaucauccagaacaccacgugggacgaccacugccaguucagccgccccucccccaucggguaccugggccuccugagccagcggacccgcgacaucuacaucucccggcgccugcucggcaccuucaccuggacgcugagcgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggcgauccggcgccugaaggccgaggcccagauguccauccagcugaucaacaaggccgugaacgcccucaucaacgaccagcugaucaugaagaaccaccuccgggacaucauggggauccccuacugcaacuacagcaaguacugguaccugaacaacacggcgaccggcaagaccucccugccccgcugcuggcuggugagcaacggcuccuaccucaacgagacccacuucagcgacgacaucgagcagcaggccgacaacaugaucacggagaugcugcagcgggaguacauggagcgccaggggaagacgccccugggccucgucgaccuguucguguucuccaccagcuucuaccugaucuccaucuuccugcaccucgugaagaucccgacccaccggcacaucgucgggaagcccugccccaagccccaccgccugaaccacaugggcaucugcagcugcgggcuguacaagcagccgggcgugcccgugaaguggaagcgguga

SEQ ID NO: 787 - RNA, 1476 nt, Artificial Sequence
  derived and/or modified CDS sequence (opt1) from Lassa virus__AIT17188__GPC
augggccagaucgugaccuucuuccaggaggucccccacgugaucgaggaggugaugaacaucguccugaucgcccucagcauccuggccgugcugaaggggcucuacaacuucgcgaccugcggcuucguggggcuggucuccuuccugcuccugugcggccgcagcugcacgaccucccuguacaaggggguguacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacagcuacgccguggacgcggccaaccacugcgggaccguggccaacggcguccugcagacguucaugcggauggccuggggcggguccuacaucgcgcuggacagcggccacggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaaggacacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccagcggcuccgcgcggaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccacgaccgggcgcaccagccugcccaagugcuggcuggucuccaacggcagcuaccugaacgagacccacuucuccgacgacaucgagcagcaggccgacaacaugaucacggagaugcuccagaaggaguacauggagcggcagggcaagaccccgcuggggcugguggaccucuucguguucagcaccuccuucuaccugaucagcaucuuccugcaccuggucaagaucccgacccaccgccacaucgugggcaaguccugccccaagccccaccggcucaaccacauggggaucugcagcugcggccuguacgggcagcccggcgugccggucaaguggaagcgcuga

SEQ ID NO: 788 - RNA, 1476 nt, Artificial Sequence
  derived and/or modified CDS sequence (opt1) from Lassa virus__AIT17192__GPC
augggccagaucgugaccuucuuccaggaggucccccacgugaucgaggaggugaugaacaucguccugaucgcccucagcauccuggccgugcugaaggggcucuacaacuucgcgaccugcggcuucaucgggcugguguccuuccugcuccugugcggccgcagcugcacgaccucccuguacaagggggucuacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguucgaggccauguccugcgacuucaacgggggcaagaucagcgugcaguacaaccucucccacagcuacgccgucgacgcggccaaccacugcgggaccguggccaacggcgugcugcagacguucaugcggauggccuggggcggguccuacaucgcgcuggacagcggccacggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaaggacacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucaugggcauccccuacugcaacuacuccaaguacugguaccugaaccacaccacgaccgggcggaccagccugcccaagugcuggcugguguccaacggcagcuaccugaacgagacccacuucuccgacgacaucgagcagcaggccgacaacaugaucacggagaugcuccagaaggaguacauggagcgccagggcaagaccccgcuggggcuggucgaccucuucguguucagcaccuccuucuaccugaucagcaucuuccugcaccuggugaagaucccgacccaccggcacaucgucggcaaguccugccccaagccccaccgccucaaccacauggggaucugcagcugcggccuguacgggcagcccggcgugccggugaaguggaagcgguga

SEQ ID NO: 789 - RNA, 1476 nt, Artificial Sequence
  derived and/or modified CDS sequence (opt1) from Lassa virus__AIT17196__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggccggugggacugcaucaugaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugaacauccagcucaucaacaaggccgugaacgcccugaucaacgaccagcugaucaugaagaaccaccuccgcgacaucauggggauccccuacugcaacuacagcaaguacugguaccugaaccacacgaccaccggcaagaccucccugccccggugcuggcucgugagcaacggcuccuaccugaacgagacgcacuucagcgacgacaucgagcagcaggccgacaacaugaucaccgagaugcugcagaaggaguacauggagcgccaggggaagacgccccucggccuggucgaccuguucguguucuccaccagcuucuaccugaucuccaucuuccuccaccuggugaagaucccgacccaccggcacaucgucgggaagcccugccccaagccccaccgccugaaccacaugggcaucugcagcugcggguucuacaagcagccgggcgugcccgugaaguggaagcgguga

SEQ ID NO: 790 - RNA, 1476 nt, Artificial Sequence
  derived and/or modified CDS sequence (opt1) from Lassa virus__AIT17204__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccagcucccuguacaaggggguguacgagcugcagacccucgagcugaacauggagacccugaacaugacgaugccgcucagcugcaccaagaacuccagccaccacuacauccgggugggcaacgagaccggccuggagcugacccucacgaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcaccguggccaacggggugcuccagacguucaugcgcauggccuggggcggcagcuacaucgcgcuggacuccgggcacgaccggugggacugcaucaugaccagcuaccaguaccugaucauccagaacaccaccugggaggaccacugccaguucucccgccccagccccaucggcuaccucgggcugcugagccagcggacgcgcgacaucuacaucucccggcgccuccugggcaccuucaccuggacccugagcgacuccgagggcaaggacacgcccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcaucccguacugcaacuacuccaaguacugguaccugaaccacaccaucacggggaagaccagccugcccaagugcuggcucguguccaacggcagcuaccugaacaagacccacuucuccgacgacaucgagcagcaggccgacaacaugaucaccgagaugcugcagaaggaguacauggagcggcagggcaagacgccccucgggcuggucgaccuguucguguucagcaccuccuucuaccugaucagcaucuuccuccaccugaucaagaucccgacccaccgccacaucgugggcaagcccugccccaagccccaccggcugaaccacauggggaucugcuccugcggccucuacaagcagccggggguccccgugaaguggaagcgcuga

SEQ ID NO: 791 - RNA, 1476 nt, Artificial Sequence
  derived and/or modified CDS sequence (opt1) from Lassa virus__AIT17208__GPC
augggccagaucgugaccuucuuccaggaggucccccacgugaucgaggaggugaugaacaucguccugaucgcccucagcauccuggccgugcugaaggggcucuacaacuucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggccagugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcgguga

SEQ ID NO: 792 - RNA, 1476 nt, Artificial Sequence
  derived and/or modified CDS sequence (opt1) from Lassa virus__AIT17210__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcgaccggugggacugcaucaugaccagcuaccaguaccugaucauccagaacaccacgugggaggaccacugccaguucucccgccccagccccaucggcuaccucgggcugcugucccagcggacccgcgacaucuacaucagccggcgccuccugggcaccuucaccuggacgcugagcgacuccgagggcaaggacacccccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcauccccuacugcaacuacuccaaguacugguaccugaaccacacgaccaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugaaguggaagcgguga

SEQ ID NO: 793 - RNA, 1476 nt, Artificial Sequence
  derived and/or modified CDS sequence (opt1) from Lassa virus__AIT17212__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccaccggaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcgcauggccuggggcggcagcuacaucgcgcuggacuccgggcggggcaagugggacugcaucaugaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucauggggauccccuacugcaacuacuccaaguacugguaccugaaccacacgaccaccggcaagaccagccugccccggugcuggcucguguccaacggcagcuaccugaacgagacgcacuucuccgacgacaucgagcagcaggccgacaacaugaucaccgagaugcugcagaaggaguacauggagcgccaggggaagacgccccucggccuggucgaccuguucguguucagcaccuccuucuaccugaucagcaucuuccuccaccuggugaagaucccgacccaccggcacaucgucgggaagcccugccccaagccccaccgccugaaccacaugggcaucugcuccugcgggcucuacaagcagccgggcgugcccgugaaguggaagcgguga

SEQ ID NO: 794 - RNA, 1476 nt, Artificial Sequence
  derived and/or modified CDS sequence (opt1) from Lassa virus__AIT17216__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggccgcugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugccccaagccccaccgccugaacuacaugggcaucugcuccugcgggcuguacaagcagccgggcgugcccgugcgguggaagcgcuga

SEQ ID NO: 795 - RNA, 1476 nt, Artificial Sequence
  derived and/or modified CDS sequence (opt1) from Lassa virus__AIT17224__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgacaccggccucgagcugacgcugaccaacaccagcaucauccagcacaaguucugcaaccucuccgacgcccacaagaagaaccuguacgaccacacccugaugagcaucaucuccacguuccaccucagcauccccaacuucaaccaguacgaggccauguccugcgacuucaacgggggcaagaucagcguccaguacaaccugucccacagcuacgccggggacgcggccucccacugcggcaccguggccaacggggugcugcagaccuucaugcgcauggccuggggcggcagcuacaucgcgcucgacuccgggcggggcaacugggacugcaucaugaccagcuaccaguaccugaucauccagaacacgaccugggaggaccacugccaguucucccgccccagccccaucggguaccugggccuccugucccagcggacccgcgacaucuacaucagccggcgccugcucggcaccuucacguggacccugagcgacuccgaggggcgggacaccccgggcggguacugccugacccgcuggaugcucaucgaggccgagcugaagugcuucggcaacacggccgucgccaagugcaacgagaagcacgacgaggaguucugcgacaugcugcggcuguucgacuucaacaagcaggccauccagcgccugaagaccgaggcgcagaugagcauccagcugaucaacaaggccgugaacgcccucaucaacgaccagcugaucaugaagaaccaccuccgggacaucauggggauccccuacugcaacuacuccaaguacugguaccucaacaacaccaucaccggcaagagcucccugcccaagugcuggcuggugagcaacggcuccuaccucaacgagacgcacuucagcgacgacaucgagcaggaggccgacaacaugaucaccgagaugcugcagaaggaguacauggagcgccaggggaagacgccccugggccucgucgaccuguucguguucuccaccagcuucuaccugaucuccaucuuccugcaccucgugaagaucccgacccaccggcacaucgucgggaagcccugccccaagccccaccgccugaaccacaugggcgugugcagcugcgggcuguacaagcagccgggcgugcccguccgguggaagcgcuga

SEQ ID NO: 796 - RNA, 1476 nt, Artificial Sequence
  derived and/or modified CDS sequence (opt1) from Lassa virus__AIT17228__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcugcucacguuccugcugcucugcggccgcuccugcaccaccagccuguacaagggggucuacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccggggacgcggccaaccacugcggcacggucgccaacggggugcuccagaccuucaugcggauggccuggggcggcagcuacaucgcgcuggacuccgggcgcggcgggugggacugcaucaugaccagcuaccaguaccugaucauccagaacaccacgugggaggaccacugccaguucucccggcccagccccaucggcuaccucggccugcugucccagcgcacccgggacaucuacaucagccgccggcuccuggggaccuucaccuggacgcugagcgacuccgagggcaaggacacccccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaaggcggaggcccagaugagcauccagcucaucaacaaggccgucaacgcccugaucaacgaccagcugaucaugaagaaccaccuccgggacaucaugggcauccccuacugcaacuacuccaaguacugguaccugaaccacacgaccaccggcaagaccagccugcccaagugcuggcucguguccaacgggagcuaccugaacgagacgcacuucuccgacgacaucgagcagcaggccgacaacaugaucaccgagaugcugcagaaggaguacauggagcgccagggcaagaccccgcucgggcugguggaccuguucgucuucagcaccuccuucuaccugaucagcaucuuccuccaccuggugaagaucccgacgcaccggcacaucgugggcaaguccugccccaagccccaccgccugaaccacauggggaucugcagcugcggccucuacaagcagcccggcgucccggugaaguggaagcgguga

SEQ ID NO: 797 - RNA, 1476 nt, Artificial Sequence
  derived and/or modified CDS sequence (opt1) from Lassa virus__AIT17232__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgaggggaagaucuccguccaguacaaccugagccacuccuacgccggcgacgcggccaaccacugcgggacgguggccaacggcgugcugcagaccuucaugcgcauggccuggggcgggagcuacaucgcgcucgacuccggccgggggaagugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccaucgagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaaguccugccccaagccccaccggcugaaccacauggggaucugcagcugcggccuguacaagcagcccggggugccggugaaguggaagcgcuga

SEQ ID NO: 798 - RNA, 1476 nt, Artificial Sequence
  derived and/or modified CDS sequence (opt1) from Lassa virus__AIT17236__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggccggaucuccguccaguacaaccugagccacuccuacgccggggaggcggccaaccacugcggcacgguggccaacggggugcugcagaccuucaugcgcauggccuggggcggcagcuacaucgcgcucgacuccgggcggggcaagugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacucccgguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaaguccugccccaagccccaccgccugaaccacaugggcaucugcagcugcgggcuguacaagcagcccggcgugccggugaaguggaagcgguga

SEQ ID NO: 799 - RNA, 1476 nt, Artificial Sequence
  derived and/or modified CDS sequence (opt1) from Lassa virus__AIT17240__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaagggguucuacgagcugcagacccucgagcugaacauggagacgcugaacaugaccaugccgcucuccugcaccaagaacaacagccaccacuacauccgggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccggggacgcggccaaccacugcggcacggucgccaacggggugcuccagaccuucaugcgcauggccuggggcggcagcuacaucgcgcuggacuccgggcggggccgcugggacugcaucaugaccagcuaccaguaccugaucauccagaacaccacgugggaggaccacugccaguucucccggcccagccccaucggguaccucggccugcugucccagaagacccgcgacaucuacaucagccggcgccuccugggcaccuucaccuggacgcugagcgacuccgaggggaaggacaccccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccauccagcggcugaaggcggaggcccagaugagcauccagcucaucaacaaggccgucaacgcccugaucaacgaccagcugaucaugaagaaccaccuccgcgacaucauggggauccccuacugcaacuacuccaaguacugguaccugaaccacacgaccaccggcaagaccagccugcccaagugcuggcucguguccaacggcagcuaccugaacgagacgcacuucuccgacgacaucgagcagcaggccgacaacaugaucaccgagaugcugcagaaggaguacauggagcggcaggggaagacgccccucggccugguggaccuguucgucuucagcaccuccuucuaccugaucagcaucuuccuccaccuggugaagaucccgacccaccgccacaucguggggaaguccugccccaagccccaccggcugaaccacaugggcaucugcagcugcgggcucuacaagcagcccggcgucccggugaaguggaagcgcuga

SEQ ID NO: 800 - RNA, 1476 nt, Artificial Sequence
  derived and/or modified CDS sequence (opt1) from Lassa virus__AIT17244__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucaccuuccugcugcucugcggccgcuccugcaccaccaaccuguacaaggggguguacgagcugcagacccucgagcugaacauggagacgcugaacaugaccaugccgcucagcugcaccaagaacuccagccaccacuacauccgggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgugggggacgccgcggaccacugcggcacgguggccaacgggguccuccagaccuucaugcgcauggccuggggcggcagcuacaucgcccuggacuccgggcggggcaagugggacugcaucaucaccagcuaccaguaccugaucauccagaacaccacgugggaggaccacugccaguucucccgccccagccccaucggguaccucggccugcugucccagcggacccgcgacaucuacaucagccggcgccuccugggcaccuucaccuggacgcugagcgacuccgaggggaaggacaccccgggcggguacugccucacccgguggaugcugaucgaggcggagcugaagugcuucggcaacaccgccguggccaagugcaacgagaagcacgacgaggaguucugcgacaugcuccgccuguucgacuucaacaagcaggccauccagcggcugaaggccgaggcgcagaugagcauccagcucaucaacaaggccgugaacgcccugaucaacgaccagcugaucaugaagaaccaccuccgcgacaucauggggauccccuacugcaacuacuccaaguacugguaccugaaccacacgaucaccggcaagaccagccugccccggugcuggcucgucuccaacggcagcuaccugaacgagacccgcuucuccgacgacaucgagcagcaggccgacaacaugaucacggagaugcugcagaaggaguacauggagcggcaggggaagacgccccucggccugguggaccuguucguguucagcaccuccuucuaccugaucagcaucuuccuccaccuggucaagaucccgacccaccgccacaucguggggaagcccugccccaagccccaccggcugaaccacaugggcaucugcuccugcgggcucuacaagcagccgggcgugcccgucaaguggaagcgcuga

SEQ ID NO: 801 - RNA, 1476 nt, Artificial Sequence
  derived and/or modified CDS sequence (opt1) from Lassa virus__AIT17246__GPC
augggccagaucgugaccuucuuccaggaggucccccacgugaucgaggaggugaugaacaucguccugaucgcccucagccugcuggccgugcucaaggggcuguacaacguggcgaccugcggccugaucgggcucaucacguuccugcugcucugcggccgcuccugcaccaccaaccuguacaagggggucuacgagcugcagacccucgagcugaacauggagacgcugaacaugaccaugccgcucagcugcaccaagaacuccagccaccacuacaucauggugggcaacgagaccggccuggagcugacgcucaccaacaccuccaucaucaaccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccgugcaguacaaccugagccacuccuacgccgucgacgccgcgaaccacugcgggaccguggccaacggcauccuccagaccuucaugcggauggccuggggcgggagcuacaucgcccuggacuccggccgcgggaacugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagaugagcauccagcucaucaacaaggccgucaacgcccugaucaacgaccagcugaucaugaagaaccaccuccgggacaucaugggcauccccuacugcaacuacuccaaguacugguaccugaaccacaccaccaccgggaagacgagccugcccaagugcuggcucguguccaacggcagcuaccugaacgagacccacuucuccgacgacaucgagcagcaggccgacaacaugaucaccgagaugcugcagaaggaguacauggagcgccagggcaagaccccgcucgggcugguggaccuguucgucuucagcacguccuucuaccugaucagcaucuuccuccaccuggugaagaucccgacccaccggcacaucgugggcaagcccugccccaagccccaccgccugaaccacauggggaucugcuccugcggccucuacaagcagccggggguccccgugcgguggaagcgcuga

SEQ ID NO: 802 - RNA, 1476 nt, Artificial Sequence
  derived and/or modified CDS sequence (opt1) from Lassa virus__AIT17250__GPC
augggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacacccucaugagcaucaucuccacguuccaccugagcauccccaacuucaaccaguacgaggccauguccugcgacuucaacgggggcaagaucagcguccaguacaaccugucccacagcuacgccguggacgccgcgaaccacugcgggaccguggccaacggcguccuccagaccuucaugcggauggccuggggcggguccuacaucgcccuggacagcggccgcgggaacugggacugcaucaugaccuccuaccaguaccugaucauccagaacacgaccugggaggaccacugccaguucagccggcccucccccaucggcuaccucgggcugcugagccagcgcacccgggacaucuacaucucccgccggcuccugggcaccuucacguggacccugagcgacagcgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagauguccauccagcucaucaacaaggccgugaacgcccugaucaacgaccagcugaucaugaagaaccaccuccgggacaucaugggcauccccuacugcaacuacagcaaguacugguaccugaaccacaccaccaccgggaagacgucccugcccaagugcuggcucgucagcaacggcuccuaccugaacgagacccacuucagcgacgacaucgagcagcaggccgacaacaugaucaccgagaugcugcagaaggaguacauggagcgccagggcaagaccccgcucgggcugguggaccuguucguguucuccacgagcuucuaccugaucuccaucuuccuccaccuggucaagaucccgacccaccggcacaucgugggcaagcccugccccaagccccaccgccugaaccacauggggaucugcagcugcggccucuacaagcagccgggggugcccguccgguggaagcgcuga

SEQ ID NO: 803 - RNA, 1476 nt, Artificial Sequence
  derived and/or modified CDS sequence (opt1) from Lassa virus__AIT17254__GPC
augggccagaucgugaccuucuuccaggaggucccccacgugaucgaggaggugaugaacaucguccugaucgcccucagcauccuggccgugcugaaggggcucuacaacuucgcgaccugcggcaucguggggcuggucacguuccugcuccugugcggccgcuccugcaccaccagccuguacaaggggguguacgagcuccagacccuggagcugaacauggagacgcucaacaugaccaugccgcuguccugcaccaagaacaacagccaccacuacaucauggugggcaacgagaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccggggacgcggccaaccacugcggcacgguggccaacggggugcugcagaccuucaugcggauggccuggggcggcagcuacaucgcgcuggacuccgggcgcgaccggugggacugcaucaugaccagcuaccaguaccucaucauccagaacaccacgugggaggaccacugccaguucucccgccccagccccaucggcuaccuggggcugcucucccagcggacccgcgacaucuacaucagccggcgccugcugggcaccuucaccuggacgcucagcgacuccgagggcaagaacacccccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggccauccagcggcucaaggcggaggcccagaugagcaucucccugaucaacaaggccgugaacgcccugaucaacgaccagcucaucaugaagaaccaccuccgcgacaucaugggcauccccuacugcaacuacagcaaguacugguaccugaaccacacgaccaccgggaagaccucccugccccggugcuggcuggugagcaacggcuccuaccugaacgagacgcacuucagcgacgacaucgagcagcaggccgacaacaugaucaccgagaugcuccagaaggaguacauggaccgccagggcaagaccccgcuggggcuggucgaccucuucguguucuccaccagcuucuaccugaucuccaucuuccugcaccuggugaagaucccgacgcaccggcacaucgucggcaagaccugccccaagccccaccgccucaaccacauggggaucugcagcugcggccuguacaagcagcccggggugccggugaaguggaagcgguga

SEQ ID NO: 804 - RNA, 1476 nt, Artificial Sequence
  derived and/or modified CDS sequence (opt1) from Lassa virus__AIT17258__GPC
augggccagaucgugaccuucuuccaggaggucccccacgugaucgaggaggugaugaacaucguccugaucgcccucagcauccuggccgugcugaaggggcucuacaacaucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucgucagcaccuuccaccucuccauccccaacuucaaccaguacgaggccaugagcugcgacuucaacgggggcaagaucuccgugcaguacaaccugagccacuccuacgccguggacgcggccaaccacugcgggacggucgccaacggcgugcugcagaccuucaugcggauggccuggggcgggagcuacaucgcgcucgacuccggccgcgggggcugggacugcaucaugaccagcuaccaguaccugaucauccagaacgugaccugggaggaccacugccaguucucccggcccagccccaucggguaccugggccuccugucccagcgcacgcgggacgucuacaucagccgccggcugcucggcaccuucaccuggacccugagcgacuccgaggggaacgacacgccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacaccacgaccggcaagaccagccugcccaagugcuggcuggucuccaacggcagcuaccucaacgagacccacuucuccgacgacaucgagcagcaggccgacaacaugaucacggagaugcugcagaaggaguacauggagcgccaggggaagacgccccugggccucguggaccuguucguguucagcaccuccuucuaccugaucagcaucuuccugcaccucgucaagaucccgacccaccggcacaucguggggaagcccugccccaagccccaccgccugaaccacaugggcaucugcuccugcgggcuguacaagcagccgggcgugcccgucaaguggaagcgguga

SEQ ID NO: 805 - RNA, 1476 nt, Artificial Sequence
  derived and/or modified CDS sequence (opt1) from Lassa virus__AIT17262__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccacgcacugcggcaccguggccaacggggugcuccagaccuucaugcggauggccuggggcggcagcuacaucgcgcuggacuccgggcgcggcaagugggacugcaucaugaccagcuaccaguaccugaucauccagaacacgaccugggaggaccacugccaguucucccggcccagccccaucggguaccucggccugcugucccagcgcacccgggacaucuacaucagccgccggcuccugggcaccuucacguggacccugagcgacuccgaggggaaggacaccccgggcggguacugccucacccgcuggaugcugaucgaggccgagcugaagugcuucggcaacacggccgucgccaagugcaacgagaagcacgacgaggaguucugcgacaugcuccggcuguucgacuucaacaagcaggccauccagcgccugaagaccgaggcgcagaugagcauccagcucaucaacaaggccgugaacgcccugaucaacgaccagcugaucaugaagaaccaccuccgggacaucauggggauccccuacugcaacuacuccaaguacugguaccugaaccacaccaccacgggcaagaccagccugccccgcugcuggcucguguccaacggcagcuaccugaacgagacccacuucuccgacgacaucgagcagcaggccgacaacaugaucaccgagaugcugcagaaggaguacauggagcggcaggggaagacgccccucggccuggucgaccuguucguguucagcaccuccuucuaccugaucagcaucuuccuccaccuggugaagaucccgacccaccgccacaucgucgggaagcccugccccaagccccaccggcugaaccacaugggcaucugcuccugcgggcucuacaagcagccgggcgugcccgugaaguggaagcgcuga

SEQ ID NO: 806 - RNA, 1476 nt, Artificial Sequence
  derived and/or modified CDS sequence (opt1) from Lassa virus__AIT17266__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccucccugaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccguccaguacaaccucagccacuccuacgccguggacgcggccaaccacugcgggacgguggccaacggcguccugcagaccuucaugcggauggccuggggcgggagcuacaucgcgcuggacuccggccgcgggggcugggacugcaucaugaccagcuaccaguaccucaucauccagaacaccacgugggaggaccacugccaguucucccggcccagccccaucggguaccugggccugcucucccagcgcacccgggacaucuacaucagccgccggcugcugggcaccuucaccuggacgcucagcgacuccgaggggaaggacaccccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggccauccagcgccucaaggcggaggcccagaugagcauccagcugaucaacaaggccgugaacgcccugaucaacgaccagcucaucaugaagaaccaccuccgggacaucauggggauccccuacugcaacuacuccaaguacugguaccugaaccacacgaccaccggccgcaccagccugccccggugcuggcuggucuccaacggcagcuaccugaacgagacgcacuucuccgacgacaucgagcagcaggccgacaacaugaucaccgagaugcuccagaaggaguacauggagcgccaggggaagacgccccugggccugguggaccuguucguguucagcaccuccuucuaccucaucagcaucuuccugcaccuggucaagaucccgacccaccggcacaucguggggaaguccugccccaagccccaccgccucaaccacaugggcaucugcagcugcgggcuguacaagcagcccggcgugccggucaaguggaagcgguga

SEQ ID NO: 807 - RNA, 1476 nt, Artificial Sequence
  derived and/or modified CDS sequence (opt1) from Lassa virus__AIT17270__GPC
augggccagaucgugaccuucuuccaggaggucccccacgugaucgaggaggugaugaacaucguccugaucgcccucagcgugcuggccgugcugaaggggcucuacaacuucgcgaccugcggccuggucgggcuggugaccuuccuccugcugugcggccgcuccugcagcaccuccguguacaagggggucuacgagcuccagacccuggagcugaacauggagacccucaacaugacgaugccgcugagcugcaccaagaacaacucccaccacuacaucauggugggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacagcuacgccgucgacgcggccaaccacugcgggaccguggccaacggcgugcugcagacguucaugcggauggccuggggcggguccuacaucgcgcuggacagcggccacgggggcugggacugcaucaugaccaacuaccaguaccucaucauccagaacaccaccugggaggaccacugccaguucucccgccccagccccaucggguaccugggccugcucucccagcggacgcgcgacaucuacaucagccggcgccugcugggcaccuucaccuggacccucagcgacuccgaggggaaggacacgccgggcggguacugccugacccgguggaugcugaucgaggccgagcucaagugcuucggcaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacaccacgaccggccggaccagccugcccaagugcuggcugguguccaacggcagcuaccugaacgagacccacuucuccgacgacaucgagcagcaggccgacaacaugaucacggagaugcuccagcgcgaguacauggagcggcaggggaagacgccccugggccuggucgaccucuucguguucagcaccuccuucuaccugaucagcaucuuccugcaccuggugaagaucccgacccaccgccacaucgucgggaaguccugccccaagccccaccggcucaaccacaugggcaucugcagcugcgggcuguacaagcagcccggcgugccggugaaguggaagcgcuga

SEQ ID NO: 808 - RNA, 1476 nt, Artificial Sequence
  derived and/or modified CDS sequence (opt1) from Lassa virus__AIT17274__GPC
augggccagaucgugaccuucuuccaggaggucccccacgugaucgaggaggugaugaacaucguccugaucgcccucagcauccuggccgugcugaaggggcucuacaacguggcgaccugcggccugacggggcuggucgccuuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucgagcaccgcuucugcaaccucuccgacgcccacaagaagaaccuguacgaccacgcccugaugagcaucaucuccaccuuccaccucagcauccccaacuucaaccaguacgaggcgauguccugcgacuucaacgggggcaagaucagcguccaguacaaccugucccacagcuacgccguggacgccgccaaccacugcgggacgguggcgaacggcguccugcagaccuucaugcggauggccuggggcggguccuacaucgcccucgacagcggccgcaacgggugggacugcaucaugaccuccuaccaguaccugaucauccagaacaccacgugggaggaccacugccaguucagccggcccucccccaucggcuaccuggggcuccugagccagcgcacccgggacaucuacaucucccgccggcugcucggcaccuucaccuggacgcugagcgacagcgagggcaaggacacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgccugaaggccgaggcccagauguccauccagcugaucaacaaggccgugaacgcgcucaucaacgaccagcugaucaugaagaaccaccuccgggacaucaugggcauccccuacugcaacuacagcaaguacugguaccucaacaacacggccaccgggaagaccucccugccccgcugcuggcuggucagcaacggcuccuaccucaacgagacccacuucagcgacgacaucgagcagcaggccgacaacaugaucacggagaugcugcagaaggaguacauggagcggcagggcaagaccccgcuggggcucguggaccuguucguguucuccaccagcuucuaccugaucuccaucuuccugcaccucgucaagaucccgacccaccgccacaucgugggcaagcccugccccaagccccaccggcugaaccacauggggaucugcagcugcggccuguacaagcagccgggggcccccgugcgcuggaagcgguga

SEQ ID NO: 809 - RNA, 1476 nt, Artificial Sequence
  derived and/or modified CDS sequence (opt1) from Lassa virus__AIT17276__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggcaagugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcgggcuguacaagcagcccggcgugccggugcgcuggaagcgguga

SEQ ID NO: 810 - RNA, 1473 nt, Artificial Sequence
  derived and/or modified CDS sequence (opt1) from Lassa virus__AIT17280__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucgaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcgcauggccuggggcggcagcuacaucgcgcucgacuccgggcacgagugggacugcaucaugaccagcuaccaguaccugaucauccagaacaccacgugggacaaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaagguggaggcgcagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcuggucuccaacggcagcuaccucaacgagacgcacuucuccgacgacaucgagcagcaggccgacaacaugaucaccgagaugcugcagaaggaguacauggagcgccagggcaagaccccgcuggggcucguggaccuguucguguucagcaccuccuucuaccugaucagcaucuuccugcaccucgucaagaucccgacgcaccggcacaucgugggcaaguccugccccaagccccaccgccugaaccacauggggaucugcagcugcggcuucuacaagcagcccggggugccggucaaguggaagcgguga

SEQ ID NO: 811 - RNA, 1476 nt, Artificial Sequence
  derived and/or modified CDS sequence (opt1) from Lassa virus__AIT17288__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccguggacgcggccaaccacugcgggacgguggccaacggcguccugcagaccuucaugcggauggccuggggcgggggcuacaucgcgcucgacagcgggcgcggcaacugggacugcaucaugaccuccuaccaguaccugaucauccagaacaccacgugggaggaccacugccaguucagccggcccucccccaucggguaccugggccuccugagccagcgcacccgggacaucuacaucucccgccggcugcucggcaccuucaccuggacgcugagcgacagcgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagauguccauccagcugaucaacaaggccgugaacgcccucaucaacgaccagcugaucaugaagaaccaccuccgggacaucauggggauccccuacugcaacuacagcaaguacugguaccucaaccacacggucaccggcaagaccucccugcccaagugcuggcuggugagcaacggcuccuaccucaacgagacccacuucagcgacgacaucgagcagcaggccgacaacaugaucacggagaugcugcagaaggaguacauggagcgccaggggaagacgccccugggccucguggaccuguucgucuucuccaccagcuucuaccugaucuccaucuuccugcaccucgugaagaucccgacccaccggcacaucgugggcaagagcugccccaagccccaccgccugaaccacauggggaucugcuccugcgggcuguacaagcagcccggcgucccggugcgguggaagcgcuga

SEQ ID NO: 812 - RNA, 1476 nt, Artificial Sequence
  derived and/or modified CDS sequence (opt1) from Lassa virus__AIT17292__GPC
augggccagaucgugaccuucuuccaggaggucccccacgugaucgaggaggugaugaacaucguccugaucgcccucagcaucauggccgugcugaaggggcuguacaacaucgcgaccugcggccucguggggcuggucacguuccugcuccugugcggccgcuccugcaccaccacccuguacaaggggguguacgagcuccagacgcuggagcugaacauggagacccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcguccaguacaaccucucccacagcuacgccggggacgcggccaaccacugcggcaccguggccaacggggugcugcagaccuucaugcggauggccuggggcggcuccuacaucgcgcuggacagcgggcacggcgggugggacugcaucaugaccuccuaccaguaccucaucauccagaacacgaccugggaggaccacugccaguucacccgccccagccccaucggcuaccugggccugcucucccagcggacccgcgacaucuacaucagccggcgccugcuggggacguucaccuggacccucuccgacagcgagggcaacgacacccccgggggcuacugccugacgcgguggaugcugaucgaggccgagcucaagugcuucgggaacaccgccgucgccaagugcaacgagaagcacgacgaggaguucugcgacaugcugcgccuguucgacuucaacaagcaggccauccagcggcuccgcgcggaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccaccacgggccgcaccagccugccccggugcuggcugguguccaacgggagcuaccugaacgagacccacuucuccgacgacaucgagcagcaggccgacaacaugaucaccgagaugcuccagaaggaguacauggagcgccagggcaagacgccccuggggcuggucgaccucuucguguucagcaccuccuucuaccugaucagcaucuuccugcaccugaucaagaucccgacccaccggcacaucgugggcaagcccugccccaagccccaccgccucaaccacaugggggucugcuccugcggccuguacaagcagccgggcgugcccgugcgguggaagcgcuga

SEQ ID NO: 813 - RNA, 1476 nt, Artificial Sequence
  derived and/or modified CDS sequence (opt1) from Lassa virus__AIT17294__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucgaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcggcgggugggacugcaucaugaccagcuaccaguaccugaucauccagaacaccacgugggaggaccacugccaguucucccggcccagccccgucggcuaccucggccugcugucccagcgcacccgggacaucuacaucagccgccggcuccuggggaccuucaccuggacgcugagcgacuccgagggcaaggacacccccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaagacggaggcgcagaugagcauccagcucaucaacaaggccgugaacgcccugaucaacgaccagcugaucaugaagaaccaccuccgggacaucaugggcauccccuacugcaacuacuccaaguacugguaccugaaccacaccaccaccggcaagacgagccugccccgcugcuggcucgucuccaacgggagcuaccugaacgagacccacuucuccgacgacaucgagcagcaggccgacaacaugaucaccgagaugcugcagaaggaguacauggagcggcagggcaagaccccgcucgggcugguggaccuguucguguucagcacguccuucuaccugaucagcaucuuccuccaccuggucaagaucccgacccaccgccacaucgugggcaagcccugccccaagccccaccggcugaaccacauggggaucugcuccugcggccucuacaagcagccgggcgugcccgucaaguggaagcgcuga

SEQ ID NO: 814 - RNA, 1476 nt, Artificial Sequence
  derived and/or modified CDS sequence (opt1) from Lassa virus__AIT17298__GPC
augggccagaucgugaccuucuuccaggaggucccccacgugaucgaggaggugaugaacaucguccugaucgcccucagcauccuggccgugcugaaggggcucuacaacaucgcgaccugcggccugcuggggcucgugugcuuccugcugcucugcggccgcuccugcaccaccagccuguacaagggggucuacgagcugcagacccucgagcugaacauggagacccugaacaugacgaugccgcucuccugcaccaagaacaacagccaccacuacaucauggugggcaacgagaccggccuggagcugacccucacgaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacuccuacgccgucgacgcggccagccacugcgggaccaucgccaacggcgugcuccagacguucaugcggauggccuggggcggguccuacaucgcgcuggacagcggccacgggggcugggacugcaucaugaccuccuaccaguaccugaucauccagaacaccaccugggaggaccacugccaguucagccgccccucccccaucggguaccucggccugcugagccagcggacgcgcgacaucuacaucagccggcgccuccugggcaccuucaccuggacccuguccgacagcgaggggaaggacacgccgggcggguacugccucacccgguggaugcugaucgaggccgagcugaagugcuucggcaacaccgccguggccaagugcaacgagaagcacgacgaggaguucugcgacaugcuccgccuguucgacuucaacaagcaggccauccagcggcugaaggcggaggcccagauguccauccagcucaucaacaaggccgucaacgcccugaucaacgaccagcugaucaugaagaaccaccuccgcgacaucauggggauccccuacugcaacuacagcaaguacugguaccugaaccacaccacgaccggcaagaccucccugcccaagugcuggcucgugagcaacggcuccuaccugaacgagacccacuucagcgacgacaucgagcagcaggccgacaacaugaucacggagaugcugcagaaggaguacauggagcggcaggggaagacgccccucggccugguggaccuguucgucuucuccaccagcuucuaccugaucuccaucuuccuccaccuggugaagaucccgacccaccgccacguggucgggaagcccugccccaagccccaccggcugaaccacaugggcaucugcagcugcgggcucuacggccagccgggcgugcccgugaaguggaagcgcuga

SEQ ID NO: 815 - RNA, 1476 nt, Artificial Sequence
  derived and/or modified CDS sequence (opt1) from Lassa virus__AIT17302__GPC
augggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucucccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccguccaguacaaccugagccacuccuacgccguggacgccgcgaaccacugcgggaccguggccaacggcguccuccagaccuucaugcggauggccuggggcgggagcuacaucgcccuggacuccggccgcgggaacugggacugcaucaugaccagcuaccaguaccugaucauccagaacacgaccugggaggaccacugccaguucucccggcccagccccaucggcuaccucgggcugcugucccagcgcacccgggacaucuacaucagccgccggcuccugggcaccuucacguggacccugagcgacuccgagggcaacgacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagaugagcauccagcucaucaacaaggccgugaacgcccugaucaacgaccagcugaucaugaagaaccaccuccgggacaucaugggcauccccuacugcaacuacuccaaguacugguaccugaaccacaccaccaccgggaagacgagccugcccaagugcuggcucgucuccaacggcagcuaccugaacgagacccacuucuccgacgacaucgagcagcaggccgacaacaugaucaccgagaugcugcagaaggaguacauggagcgccagggcaagaccccgcucgggcugguggaccuguucguguucagcacguccuucuaccugaucagcaucuuccuccaccuggucaagaucccgacccaccggcacaucgugggcaagcccugccccaagccccaccgccugaaccacauggggaucugcuccugcggccucuacaagcagccgggggugcccguccgguggaagcgcuga

SEQ ID NO: 816 - RNA, 1476 nt, Artificial Sequence
  derived and/or modified CDS sequence (opt1) from Lassa virus__AIT17310__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccacgcacugcggcaccguggccaacggggugcuccagaccuucaugcggauggccuggggcggcagcuacaucgcgcuggacuccgggcgcggcaagugggacugcaucaugaccagcuaccaguaccugaucauccagaacacgaccugggaggaccacugccaguucucccggcccagccccaucggguaccucggccugcugucccagcgcacccgggacaucuacaucagccgccggcuccugggcaccuucacguggacccugagcgacuccgaggggaaggacaccccgggcggguacugccucacccgcuggaugcugaucgaggccgagcugaagugcuucggcaacacggccgucgccaagugcaacgagaagcacgacgaggaguucugcgacaugcuccggcuguucgacuucaacaagcaggccauccagcgccugaagaccgaggcgcagaugagcauccagcucaucaacaaggccgugaacgcccugaucaacgaccagcugaucaugaagaaccaccuccgggacaucauggggauccccuacugcaacuacuccaaguacugguaccugaaccacaccaccacgggcaagaccagccugccccgcugcuggcucguguccaacggcagcuaccugaacgagacccacuucuccgacgacaucgagcagcaggccgacaacaugaucaccgagaugcugcagaaggaguacauggagcggcaggggaagacgccccucggccuggucgaccuguucguguucagcaccuccuucuaccugaucagcaucuuccuccaccuggugaagaucccgacccaccgccacaucgucgggaagcccugccccaagccccaccggcugaacuacaugggcaucugcuccugcgggcucuacaagcagccgggcgugcccgugaaguggaagcgcuga

SEQ ID NO: 817 - RNA, 1476 nt, Artificial Sequence
  derived and/or modified CDS sequence (opt1) from Lassa virus__AIT17314__GPC
augggccagaucgugaccuucuuccaggaggucccccacgugaucgaggaggugaugaacaucguccugaucacccucagcauccuggccgugcugaaggggcucuacaacguggccacgugcggccuggucgggcuggugaccuuccuccugcugugcggccgcuccugcaccaccagccucuacaaggggguguacgagcugcagacgcuggagcucaacauggagacccugaacaugaccaugccgcuguccugcaccaagaacaacagccaccacuacaucauggucggcaacgagacgggccucgagcugacccugaccaacaccuccaucaucaaccacaaguucugcaaccucagcgacgcgcacaagaaggaccuguacgaccacgcccugauguccaucaucagcacguuccaccucuccauccccaacuucaaccaguacgaggccaugagcugcgacuucaacgggggcaagaucuccgugcaguacaaccugagccacuccuacgccguggacgccgcgaaccacugcgggaccgucgccaacggcgugcugcagaccuucaugcggauggccuggggcgggagcuacaucgcccucgacuccggccgcgggggcugggacugcaucaugaccagcuaccaguaccugaucauccagaacacgaccugggaggaccacugccaguucucccggcccagccccaucggguaccugggccuccugucccagcgcacccgggacaucuacaucagccgccggcugcucggcaccuucacguggacccugagcgacuccgaggggaacgacaccccgggcggguacugccugacccgcuggaugcucaucgaggcggagcugaagugcuucggcaacacggccguggccaagugcaacgagaagcacgacgaggaguucugcgacaugcugcggcuguucgacuucaacaagcaggccauccagcgccugaaggccgaggcgcagaugagcauccagcugaucaacaaggccgucaacgcccucaucaacgaccagcugaucaugaagaaccaccuccgggacaucauggggauccccuacugcaacuacuccaaguacugguaccucaaccacaccaccaccggcaagacgagccugcccaagugcuggcugguguccaacggcagcuaccucaacgagacccacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaagcccugccccaagccccaccgccugaaccacaugggcaucugcuccugcgggcuguacaagcagccgggcguccccgugaaguggaagcgguga

SEQ ID NO: 818 - RNA, 1476 nt, Artificial Sequence
  derived and/or modified CDS sequence (opt1) from Lassa virus__AIT17318__GPC
augggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaaggggguguacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgggggcaagaucagcguccaguacaaccugucccacagcuacgccguggacgcggccaaccacugcgggacgguggccaacggcguccuccagaccuucaugcggauggccuggggcggguccuacaucgcgcuggacagcggccgcgggaacugggacugcaucaugaccuccuaccaguaccugaucauccagaacaucaccugggaggaccacugccaguucagccggcccucccccaucggcuaccucgggcugcugagccagcgcacgcgggacaucuacaucucccgccggcuccugggcaccuucaccuggacccugagcgacagcgagggcaacgacacgcccgggggcuacugccucacccgcuggaugcugaucgaggccgagcugaagugcuucgggaacaccgccguggccaagugcaacgagaagcacgacgaggaguucugcgacaugcuccggcuguucgacuucaacaagcaggccauccagcgccugaaggcggaggcccagauguccauccagcucaucaacaaggccgugaacgcccugaucaacgaccagcugaucaugaagaaccaccuccgggacaucaugggcauccccuacugcaacuacagcaaguacugguaccugaaccacaccacgaccgggaagaccucccugcccaagugcuggcucgucagcaacggcuccuaccugaacgagacccacuucagcgacgacaucgagcagcaggccgacaacaugaucacggagaugcugcagaaggaguacauggagcgccagggcaagaccccgcucgggcugguggaccuguucguguucuccaccagcuucuaccugaucuccaucuuccuccaccuggucaagaucccgacccaccggcacaucgugggcaagcccugccccaagccccaccgccugaaccacauggggaucugcagcugcggccucuacaagcagccgggggugcccguccgguggaagcgcuga

SEQ ID NO: 819 - RNA, 1476 nt, Artificial Sequence
  derived and/or modified CDS sequence (opt1) from Lassa virus__AIT17322__GPC
augggccagaucgugaccuucuuccaggaggucccccacgugaucgaggaggugaugaacaucguccugaucgcccucagccugcuggccgugcucaaggggcuguacaacguggcgaccugcggccugaucgggcucgucacguuccugcugcucugcggccgcuccugcaccaccaaccuguacaagggggccuacgagcugcagacccucgagcugaacauggagacgcugaacaugaccaugccgcucagcugcaccaagaacaacucccaccacuacaucauggugggcaacgagaccggccuggagcugacgcucaccaacaccagcaucaucaaccacaaguucugcaaccuguccgacgcccacaagaagaaccuguacgaccacacccucaugagcaucaucuccacguuccaccugagcauccccaacuucaaccaguacgaggccauguccugcgacuucaacgggggcaagaucagcgugcaguacaaccugucccacagcuacgccgucgacgcggccaaccacugcgggaccguggccaacggcgugcuccagaccuucaugcggauggccuggggcggguccuacaucgcgcuggacagcggccgcgggaacugggacugcaucaugaccuccuaccaguaccugaucauccagaacacgaccugggaggaccacugccaguucagccggcccucccccaucggcuaccucgggcugcugagccagcgcacccgggacaucuacaucucccgccggcuccugggcaccuucacguggacccugagcgacagcgagggcaacgacacccccgggggcuacugccucacccgcuggaugcugaucgaggccgagcugaagugcuucgggaacacggccgucgccaagugcaacgagaagcacgacgaggaguucugcgacaugcuccggcuguucgacuucaacaagcaggccauccagcgccugaaggcggaggcccagauguccauccagcucaucaacaaggccgugaacgcccugaucaacgaccagcugaucaugaagaaccaccuccgggacaucaugggcauccccuacugcaacuacagcaaguacugguaccugaaccacaccaccaccgggaagacgucccugcccaagugcuggcucgugagcaacggcuccuaccugaacgagacccacuucagcgacgacaucgagcagcaggccgacaacaugaucaccgagaugcugcagaaggaguacauggagcgccagggcaagaccccgcucgggcuggucgaccuguucguguucuccacgagcuucuaccugaucuccaucuuccuccaccuggugaagaucccgacccaccggcacaucgucggcaagcccugccccaagccccaccgccugaaccacauggggaucugcagcugcggccucuacaagcagccgggggugcccgugcgguggaagcgcuga

SEQ ID NO: 820 - RNA, 1476 nt, Artificial Sequence
  derived and/or modified CDS sequence (opt1) from Lassa virus__AIT17328__GPC
augggccagaucgugaccuucuuccaggaggucccccacgugaucgaggaggugaugaacaucguccugaucacccucagcauccuggccgugcugaaggggcucuacaacaucgccacgugcggccugguggggcuggucaccuuccuccugcugugcggcaaguccugcaccaccagccucuacaaggggguguacgagcugcagacgcuggagcucaacauggagacccugaacaugaccaugccgcuguccugcaccaagaacaacagccaccacuacauccgcgugggcaacgagacgggccucgagcugacccugaccaacaccuccaucaucaaccacaaguucugcaaccucagcgacgcgcacaagaagaaccuguacgaccacgcccugauguccaucaucagcacguuccaccucuccauccccaacuucaaccaguacgaggccaugagcugcgacuucaacgggggcaagaucuccguccaguacaaccugagccacuccuacgccguggacgccgcgaaccacugcgggaccguggccaacggcguccugcagaccuucaugcggauggccuggggcgggagcuacaucgcccucgacuccggccacgggaacugggacugcaucaugaccagcuaccaguaccugaucauccagaacacgaccugggaggaccacugccaguucucccgccccagccccaucggcuaccuggggcuccugucccagcggacccgcgacaucuacaucagccggcgccugcucggcaccuucacguggacccugagcgacuccgagggcaacgacgcgcccgggggcuacugccugacccgguggaugcucaucgaggccgagcugaagugcuucgggaacaccgccguggccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcuggucuccaacggcagcuaccucaacgagacgcacuucuccgacgacaucgagcagcaggccgacaacaugaucaccgagaugcugcagaaggaguacauggagcggcagggcaagaccccgcuggggcucguggaccuguucguguucagcaccuccuucuaccugaucagcaucuuccugcaccucgucaagaucccgacgcaccgccacguggugggcaaguccugccccaagccccaccggcugaaccacauggggaucugcagcugcggccuguacaagcagcccggggucccggugaaguggaagcgcuga

SEQ ID NO: 821 - RNA, 1476 nt, Artificial Sequence
  derived and/or modified CDS sequence (opt1) from Lassa virus__AIT17332__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacauccgggugggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccguccaguacaaccugagccacuccuacgccguggacgcggccaaccacugcgggacgguggccaacggcguccuccagaccuucaugcgcauggccuggggcgggagcuacaucgcgcuggacuccggccacgggcggugggacugcaucaugaccagcuaccaguaccugaucauccagaacaccacgugggaggaccacugccucuucucccgccccagccccaucggcuaccuggggcugcucucccagcggacccgcgacaucuacaucagccggcgccugcugggcaccuucaccuggacgcucagcgacuccgagggccgggacacccccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggccauccagcgccucaaggcggaggcccagaugagcauccagcugaucaacaaggccgugaacgcccugaucaacgaccagcucaucaugaagaaccaccuccgggacaucaugggcauccccuacugcaacuacuccaaguacugguaccugaaccacacgaccaccgggcgcaccagccugccccggugcuggcuggucuccaacggcagcuaccugaacgagacgcacuucuccgacgacaucgagcagcaggccgacaacaugaucaccgagaugcuccagaaggaguacauggagcgccagggcaagaccccgcuggggcugguggaccuguucguguucagcaccuccuucuaccucaucagcaucuuccugcaccuggucaagaucccgacgcaccggcacaucgugggcaaguccugccccaagccccaccgccucaaccacauggggaucugcagcugcggccuguacaagcagcccggggugccggucaaguggaagcgguga

SEQ ID NO: 822 - RNA, 1476 nt, Artificial Sequence
  derived and/or modified CDS sequence (opt1) from Lassa virus__AIT17340__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucaccuuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaucuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcggcgagugggacugcaucaugaccagcuaccaguaccugaucauccagaacaccaccugggaggaccacugccaguucucccggcccagccccaucggguaccugggccuccugucccagcgcacgcgggacaucuacaucagccgccggcugcucggcaccuucaccuggacccugagcgacuccgaggggaaggacacgccgggcggguacugccugacccgcuggaugcucaucgaggccgagcugaagugcuucggcaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccucaaccacaccacgaccggcaagaccagccugcccaagugcuggcugguguccaacggcagcuaccucaacgagacccacuucuccgacgacaucgagcagcaggccgacaacaugaucacggagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugcccccgcccccaccggcugaaccacaugggcaucugcuccugcgggcuguacaagcagccgggcgugcccgugaaguggaagcgcuga

SEQ ID NO: 823 - RNA, 1476 nt, Artificial Sequence
  derived and/or modified CDS sequence (opt1) from Lassa virus__AIT17344__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacaaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccagccacugcggcacgguggccaacggggugcugcagaccuucaugcggauggccuggggcggcuccuacaucgcgcucgacagcggguacggcaagugggacugcaucaugaccuccuaccaguaccugaucauccagaacaccacgugggaggaccacugccaguucagccgccccucccccaucggguaccugggccuccugagccagcggacccgcgacaucuacaucagccggcgccugcucggcaccuucaccuggacgcuguccgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccagcggcugaagacggaggcgcagauguccauccagcugaucaacaaggccgugaacgcccucaucaacgaccagcugaucaugaagaaccaccuccgcgacaucauggggauccccuacugcaacuacagcaaguacugguaccugaaccacaccaccaccggcaagacgucccugcccaagugcuggcuggugagcaacggcuccuaccucaacgagacccacuucagcgacgacaucgagcagcaggccgacaacaugaucaccgagaugcugcagaaggaguacauggagcggcaggggaagacgccccugggccucgucgaccuguucguguucuccaccagcuucuaccugaucuccaucuuccugcaccucgugaagaucccgacccaccgccacaucgucggcaagagcugccccaagccccaccggcugaaccacauggggaucugcuccugcgggcuguacaagcagcccggcgugccggugcgcuggaagcgguga

SEQ ID NO: 824 - RNA, 1476 nt, Artificial Sequence
  derived and/or modified CDS sequence (opt1) from Lassa virus__AIT17348__GPC
augggccagaucgugaccuucuuccaggaggucccccacgugaucgaggaggugaugaacaucguccugaucgcccucagcauccuggccgugcugaaggggcucuacaacaucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggccggugggacugcaucaugaccagcuaccaguaccugaucauccagaacaccacgugggaggaccacugccaguucucccgccccagccccaucggguaccugggccuccugucccagcggacccgcgacaucuacaucagccggcgccugcucggcaccuucaccuggacgcugagcgacuccgaggggaacgacaccccgggcggguacugccugacccgguggaugcucaucgaggccgagcugaagugcuucggcaacaccgccguggccaagugcaacgagaagcacgacgaggaguucugcgacaugcugcgccucuucgacuucaacaagcaggccauccagcggcugaaggcggaggcccagaugagcauccagcugaucaacaaggccgucaacgcccucaucaacgaccagcugaucaugaagaaccaccuccgcgacaucauggggauccccuacugcaacuacuccaaguacugguaccugaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcggcaggggaagacgccccugggccucguggaccuguucgucuucagcaccuccuucuaccugaucagcaucuuccugcaccucgugaagaucccgacccaccgccacaucguggggaagcccugccccaagccccaccggcugaaccacaugggcaucugcuccugcgggcuguacaagcagccgggcguccccgugaaguggaagcgcuga

SEQ ID NO: 825 - RNA, 1476 nt, Artificial Sequence
  derived and/or modified CDS sequence (opt1) from Lassa virus__AIT17350__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacaucauggugggcaacgagaccggccucgagcugacgcugaccaacaccagcaucaucgaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaagaucagcguccaguacaaccugucccacagcuacgcgggggacgccgccaagcacugcggcacgguggccaacggggugcugcagaccuucaugcggauggcguggggcggcuccuacaucgcccucgacagcgggcgcaacggcugggacugcgucaugaccuccuaccaguaccugaucauccagaacaccacgugggaggaccacugccaguucagccggcccucccccaucggguaccugggccuccugagccagcgcacccgggacaucuacaucucccgccggcugcucggcaccuucaccuggacgcugagcgacagcgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggcgauccagcgccugaagacggaggcccagauguccauccagcugaucaacaaggccgugaacgcccucaucaacgaccagcugaucaugaagaaccaccuccgggacaucauggggauccccuacugcaacuacagcaaguacugguaccucaaccacaccgucaccggcaagaccucccugccccgcugcuggcuggugagcaacggcuccuaccucaacgagacgcacuucagcgacgacaucgagcagcaggccgacaacaugaucaccgagaugcugcagaaggaguacaucgagcggcaggggaagacgccccugggccucguggaccuguucgucuucuccaccagcuucuaccugaucuccaucuuccugcaccucgugaagaucccgacccaccgccacaucaucgggaagcccugccccaagccccaccggcugaaccacaugggcaucugcagcugcgggcuguacaagcagccgggcgugcccguccgcuggaagcgguga

SEQ ID NO: 826 - RNA, 1476 nt, Artificial Sequence
  derived and/or modified CDS sequence (opt1) from Lassa virus__AIT17354__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaucuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcacggcgggugggacugcaucaugaccagcuaccaguaccugaucauccagaacaccaccugggaggaccacugccaguucucccgccccagccccaucggcuaccugggccuccugucccagcggacgcgcgacaucuacaucagccggcgccugcucgggaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacaccacgaccggcaagaccagccugcccaagugcuggcugguguccaacgggagcuaccucaacgagacccacuucuccgacgacaucgagcagcaggccgacaacaugaucacggagaugcugcagaaggaguacauggagcggcagggcaagaccccgcuggggcucgucgaccuguucguguucagcaccuccuucuaccugaucagcaucuuccugcaccucgugaagaucccgacccaccgccacaucgucggcaagcccugcccccggccccaccgccugaaccacauggggaucugcuccugcggccuguacaagcagccgggcgugcccgugaaguggaagcgguga

SEQ ID NO: 827 - RNA, 1476 nt, Artificial Sequence
  derived and/or modified CDS sequence (opt1) from Lassa virus__AIT17360__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacauccgggugggcaacgagaccggccucgagcugacgcugaccaacaccuccaucaucaaccaccgcuucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacggcaagugggacugcaucaugaccagcuaccaguaccugaucauccagaacaccacgugggacgaccacugccaguucucccgccccagccccaucggguaccugggccuccugucccagcggacccgcgacaucuacaucagccggcgccugcucggcaccuucaccuggacgcugagcgacuccgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggccauccggcgccugaaggcggaggcccagaugagcauccagcugaucaacaaggccgugaacgcccucaucaacgaccagcugaucaugaagaaccaccuccgggacaucauggggauccccuacugcaacuacuccaaguacugguaccugaaccacacgaccaccggcaagaccagccugccccgcugcuggcugguguccaacggcagcuaccucaacgagacgcacuucuccgacgacaucgagcagcaggccgacaacaugaucaccgagaugcugcagaaggaguacauggagcggcaggggaagacgccccugggccucgucgaccuguucguguucagcaccuccuucuaccugaucagcaucuuccugcaccucgugaagaucccgacccaccgccacaucgucgggaaguccugccccaagccccaccggcugaaccacaugggcaucugcagcugcggguucuacaagcagcccggcgugccggugaaguggaagcgcuga

SEQ ID NO: 828 - RNA, 1476 nt, Artificial Sequence
  derived and/or modified CDS sequence (opt1) from Lassa virus__AIT17364__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacaucgagcggcagggcaagaccccgcuggggcucgucgaccuguucguguucagcaccuccuucuaccugaucagcaucuuccugcaccucgugaagaucccgacgcaccgccacaucgucggcaagcccugccccaagccccaccggcugaaccacauggggaucugcuccugcggccuguacaagcagccgggggugagcgugaaguggaagcgcuga

SEQ ID NO: 829 - RNA, 1476 nt, Artificial Sequence
  derived and/or modified CDS sequence (opt1) from Lassa virus__AIT17368__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguucgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcacagcaagugggacugcaucaugaccuccuaccaguaccugaucauccagaacaccacgugggacgaccacugccaguucagccgccccucccccaucggcuaccuggggcuccugagccagcggacccgcgacaucuacaucagccggcgccugcucggcaccuucaccuggacgcuguccgacagcgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagauguccauccagcugaucaacaaggccgugaacgcccucaucaacgaccagcugaucaugaagaaccaccuccgcgacaucaugggcauccccuacugcaacuacagcaaguacugguaccugaaccacacgaccaccgggaagaccucccugcccaagugcuggcuggugagcaacggcuccuaccucaacgagacgcacuucagcgacgacaucgagcagcaggccgacaacaugaucaccgagaugcugcagaaggaguacauggagcggcagggcaagaccccgcuggggcucgucgaccuguucguguucuccaccagcuucuaccugaucuccaucuuccugcaccucgugaagaucccgacgcaccgccacaucgucggcaagagcugccccaagccccaccggcugaacuacauggggaucugcuccugcggcuucuacaagcagcccggggugccggugaaguggaagcgcuga

SEQ ID NO: 830 - RNA, 1476 nt, Artificial Sequence
  derived and/or modified CDS sequence (opt1) from Lassa virus__AIT17370__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcacgguggccaacggggugcugcagaccuucaugcggauggccuggggcggcagcuacaucgcgcucgacuccgggcgcgaccggugggacugcaucaugaccagcuaccaguaccugaucauccagaacaccacgugggaggaccacugccaguucucccgccccagccccaucggcuaccuggggcuccugucccagcggacccgcgacaucuacaucagccggcgccugcucggcaccuucaccuggacgcugagcgacuccgagggcaaggacacccccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcggcagggcaagaccccgcuggggcucgucgaccuguucguguucagcaccuccuucuaccugaucagcaucuuccugcaccucgugaagaucccgacgcaccgccacaucgucggcaagcccugccccaagccccaccggcugaaccacauggggaucugcuccugcggccuguacaagcagccgggggugagcgugaaguggaagcgcuga

SEQ ID NO: 831 - RNA, 1476 nt, Artificial Sequence
  derived and/or modified CDS sequence (opt1) from Lassa virus__AIT17378__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacgaccacacccucauguccaucaucagcacguuccaccuguccauccccaacuucaaccaguacgaggccaugagcugcgacuucaacgggggcaagaucuccguccaguacaaccugagccacuccuacgccguggacgccgcgaaccacugcgggaccguggccaacggcguccuccagaccuucaugcggauggccuggggcgggagcuacaucgcccuggacuccggccgcagcgggugggacugcaucaugaccuccuaccaguaccuggugauccagaacacgaccugggaggaccacugccaguucagccggcccucccccaucggcuaccucgggcugcugagccagcgcacccgggacaucuacaucagccgccggcuccugggcaccuucacguggacccuguccgacagcgagggcaagaacacccccgggggcuacugccucacccgcuggaugcugaucgaggcggagcugaagugcuucgggaacacggccguggccaagugcaacgagaagcacgacgaggaguucugcgacaugcuccggcuguucgacuucaacaagcaggccauccagcgccugaaggccgaggcgcagauguccauccagcucaucaacaaggccgucaacgcccugaucaacgaccagcugaucaugaagaaccaccuccgggacaucaugggcauccccuacugcaacuacagcaaguacugguaccugaaccacaccaccaccgggcgcacgucccugccccggugcuggcucgugagcaacggcuccuaccugaacgagacccacuucagcgacgacaucgagcagcaggccgacaacaugaucaccgagaugcugcagaaggaguacauggagcgccagggcaagaccccgcucgggcugguggaccuguucgucuucuccacgagcuucuaccugaucuccaucuuccuccaccuggugaagaucccgacccaccggcacaucgugggcaagagcugccccaagccccaccgccugaaccacauggggaucugcuccugcggcuucuacaagcagcccggggucccggugaaguggaagcgguga

SEQ ID NO: 832 - RNA, 1476 nt, Artificial Sequence
  derived and/or modified CDS sequence (opt1) from Lassa virus__AIT17388__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacgggggcaucaucagcguccaguacaaccugucccacagcuacgcgggggacgccgccaaccacugcggcacgguggccaacggggugcugcagaccuucaugcgcauggcguggggcggcuccuacaucgcccucgacagcgggcggaacggcugggacugcaucaugaccuccuaccaguaccugaucauccagaacaccacgugggacgaccacugccaguucagccgccccucccccaucggguaccugggccuccugagccagcggacccgcgacaucuacaucucccggcgccugcucggcaccuucaccuggacgcugagcgacagcgaggggaaggacaccccgggcggguacugccugacccgguggaugcucaucgaggccgagcugaagugcuucggcaacaccgccgucgccaagugcaacgagaagcacgacgaggaguucugcgacaugcugcgccucuucgacuucaacaagcaggcgauccagcggcugaagacggaggcccagaugaacauccagcugaucaacaaggccgugaacgcccucaucaacgaccagcugaucaugaagaaccaccuccgcgacaucauggggauccccuacugcaacuacuccaaguacugguaccugaacaacaccgccaccggcaagaccagccugccccggugcuggcugguguccaacggcagcuaccucaacgagacgcacuucuccgacgacaucgagcagcaggcggacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacaucgucgggaagcccugccccaagccccaccgccugaaccacaucggcaucugcuccugcgggcuguacaagcagccgggcgugcccgugaaguggaagcgguga

SEQ ID NO: 833 - RNA, 1473 nt, Artificial Sequence
  derived and/or modified CDS sequence (opt1) from Lassa virus__AIT17404__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucaucaagaucccgacccaccgccacaucaccggcaagcccugccccaagccccaccggcugaaccacauggggaucugcuccugcggccuguacaagcacccgggggugcccgugaaguggaagcgcuga

SEQ ID NO: 834 - RNA, 1473 nt, Artificial Sequence
  derived and/or modified CDS sequence (opt1) from Lassa virus__AIT17408__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccgucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguacaagcacccgggggugcccgugaaguggaagcgcuga

SEQ ID NO: 835 - RNA, 1473 nt, Artificial Sequence
  derived and/or modified CDS sequence (opt1) from Lassa virus__AIT17412__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccuccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggcgaagugcaacgagaagcacgacgaggaguucugcgacaugcugcgccuguucgacuucaacaagcaggccauccggcgccucaagaccgaggcccagauguccauccagcugaucaacaaggccgugaacgcccugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggcggacaacaugaucaccgagcuccugcagaaggaguacaucgaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcuga

SEQ ID NO: 836 - RNA, 1473 nt, Artificial Sequence
  derived and/or modified CDS sequence (opt1) from Lassa virus__AIT17416__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcgcauggccuggggcggguccuacaucgcccuggacagcggcaagggguccugggacugcaucaugacgagcuaccaguaccucaucauccagaacaccuccugggaggaccacugccaguucagccggcccagccccaucggcuaccuggggcugcucucccagcgcacccgggacaucuacaucagccgccggcugcugggcaccuucacguggacccucuccgacagcgagggcaacgagacccccgggggcuacugccugacccgcuggaugcugaucgaggccgagcucaagugcuucgggaacacggccguggcgaagugcaacgagaagcacgacgaggaguucugcgacaugcugcggcuguucgacuucaacaagcaggccauccgccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacaccgucaccgggaagacgucccugccccggugcuggcuggugagcaacggcuccuaccugaacgagacccacuucagcgacgacaucgagcagcaggcggacaacaugaucaccgagcuccugcagaaggaguacaucgaccgccagggcaagaccccgcuggggcucguggaccuguucgucuucuccacgagcuucuaccugaucuccaucuuccugcaccucgugaagaucccgacccaccggcacgugaucggcaagcccugccccaagccccaccgccugaaccacauggggaucugcagcugcggccuguacaagcacccggggguccccgugaaguggaagcgguga

SEQ ID NO: 837 - RNA, 1473 nt, Artificial Sequence
  derived and/or modified CDS sequence (opt1) from Lassa virus__AIT17420__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucaucaagaucccgacccaccgccacaucacgggcaagcccugccccaagccccaccggcugaaccacauggggaucugcuccugcggccuguacaagcacccgggggugcccgugaaguggaagcgcuga

SEQ ID NO: 838 - RNA, 1473 nt, Artificial Sequence
  derived and/or modified CDS sequence (opt1) from Lassa virus__AIT17424__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacaaccacgcccugaugagcaucaucuccaccuuccaccugagcauccccaacuucaaccaguacgaggccauguccugcgacuucaacgggggcaagaucagcgugcaguacaaccucucccacgccuacgcgguggacgccgccaaccacugcgggaccaucgccaacggcguccugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagacgaacauccagcugaucaacaaggccgugaacgcccugaucaacgaccagcucaucaugaagaaccaccuccgggacaucaugggcauccccuacugcaacuacuccaaguacugguaccugaaccacaccgucaccgggaagaccagccugccccgcugcuggcugguguccaacggcagcuaccugaacgagacgcacuucuccgacgacaucgagcagcaggccgacaacaugaucaccgagcuccugcagaaggaguacauggaccggcagggcaagaccccgcuggggcucguggaccuguucgucuucagcaccuccuucuaccugaucagcaucuuccugcaccucgugaagaucccgacgcaccgccacaucaucggcaagcccugccccaagccccaccggcugaaccacauggggaucugcuccugcggccuguacaagcacccgggggugcccgucaaguggaagcgcuga

SEQ ID NO: 839 - RNA, 1473 nt, Artificial Sequence
  derived and/or modified CDS sequence (opt1) from Lassa virus__AIT17428__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgccgccgaccucaagugcuucgggaacaccgccguggcgaagugcaacgagaagcacgacgaggaguucugcgacaugcugcgccuguucgacuucaacaagcaggccaucgagcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggcggaccagccugccccgcugcuggcugguguccaacggcagcuaccugaacgagacccacuucuccgacgacaucgagcagcaggcggacaacaugaucacggagcuccugcagaaggaguacauggaccggcagggcaagaccccgcuggggcucguggaccuguucgucuucagcaccuccuucuaccugaucagcaucuuccugcaccucgugcgcaucccgacccaccggcacgugaucggcaagcccugccccaagccccaccgccugaaccacauggggaucugcuccugcggccuguacaagcacccggggguccccgugaaguggaagcgguga

SEQ ID NO: 840 - RNA, 1473 nt, Artificial Sequence
  derived and/or modified CDS sequence (opt1) from Lassa virus__AIT17430__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggccggaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcgguga

SEQ ID NO: 841 - RNA, 1473 nt, Artificial Sequence
  derived and/or modified CDS sequence (opt1) from Lassa virus__AIT17438__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacauccgggucggcaacgagaccggccuggagcucacccugaccaacacgagcaucaucucccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaaggagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugaacauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggccgacaacaugaucacggagcuccugcagaaggaguacaucgaccgccagggcaagaccccgcuggggcucguggaccuguucgucuucuccaccagcuucuaccugaucuccaucuuccugcaccucgugaagaucccgacccaccggcacgugaucggcaagcccugccccaagccccaccgccugaaccagauggggaucugcagcugcggccuguacaagcagccggggguccccgugaaguggaagcgguga

SEQ ID NO: 842 - RNA, 1473 nt, Artificial Sequence
  derived and/or modified CDS sequence (opt1) from Lassa virus__AIT17442__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcgcauggccuggggcggguccuacaucgcccuggacagcggcaagggguccugggacugcaucaugacgagcuaccaguaccucaucauccagaacaccuccugggaggaccacugccaguucagccggcccagccccaucggcuaccuggggcugcucucccagcgcacccgggacaucuacaucagccgccggcugcugggcaccuucacguggacccucuccgacagcgagggcaacgagacccccgggggcuacugccugacccgcuggaugcugaucgaggccgagcucaagugcuucgggaacacggccguggcgaagugcaacgagaagcacgacgaggaguucugcgacaugcugcggcuguucgacuucaacaagcaggccauccgccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacaccgucaccgggaagacgucccugccccggugcuggcuggugagcaacggcuccuaccugaacgagacccacuucagcgacgacaucgagcagcaggcggacaacaugaucaccgagcuccugcagaaggaguacaucgaccgccagggcaagaccccgcuggggcucguggaccuguucgucuucuccacgagcuucuaccugaucuccaucuuccugcaccucgugaagaucccgacccaccggcacgugaucggcaagcccugccccaagccccaccgcaucaaccacauggggaucugcagcugcggccuguacaagcacccggggguccccgugaaguggaagcgguga

SEQ ID NO: 843 - RNA, 1473 nt, Artificial Sequence
  derived and/or modified CDS sequence (opt1) from Lassa virus__AIT17446__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccucccacugcgggaccgucgccaacggcgugcugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccagccccaucggcuaccuggggcugcucucccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugccccgcugcuggcuggugagcaacggcuccuaccugaacgagacccacuucagcgacgacaucgagcagcaggccgacaacaugaucacggagcuccugcagaaggaguacauggaccggcagggcaagaccccgcuggggcucgucgaccuguucguguucuccaccagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcuga

SEQ ID NO: 844 - RNA, 1473 nt, Artificial Sequence
  derived and/or modified CDS sequence (opt1) from Lassa virus__AIT17450__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacaucaucggcaagcccugccccaagccccaccggcugaaccacauggggaucugcuccugcggccuguacaagcacccgggggugcccgucaaguggaagcgcuga

SEQ ID NO: 845 - RNA, 1473 nt, Artificial Sequence
  derived and/or modified CDS sequence (opt1) from Lassa virus__AIT17454__GPC
augggccagaucaucaccuucuuccaggaggugccccacgucaucgaggaggugaugaacaucgugcugaucgccuucagccuccuggccauccugaaggggaucuacaacgucgcgaccugcggccucuucgggcugguguccuuccugcuccugugcggccgcagcugcuccaccaccuacaaggggguguacgagcugcagacccucgagcuggacauggccagccugaacaugaccaugccgcucuccugcacgaagaacaacagccaccacuacaucauggucggcaacgagaccggccuggagcugacccucaccaacacguccaucaucaaccacaaguucugcaaccugagcgacgcccacaagcggaaccuguacgaccacgcccucauguccaucaucagcaccuuccaccuguccauccccaacuucaaccaguacgaggccaugagcugcgacuucaacgggggcaagaucuccgugcaguacaaccugagccacaccuacgcgguggacgccgccgggcacugcggcaccaucgccaacgggguccuccagacguucaugcgcauggcguggggcggcuccuacaucgcccuggacagcgggaagggcuccugggacugcaucaugaccagcuaccaguaccugaucauccagaacaccaccugggaggaccacugccaguucucccggcccagccccaucggguaccucggccugcugagccagcgcacgcgggacaucuacaucucccgccggcuccugggcaccuucaccuggacccugagcgacuccgaggggaacgagacgccgggcggguacugccucacccgcuggaugcugaucgaggccgagcugaagugcuucggcaacaccgccguggccaagugcaacgagaagcacgacgaggaguucugcgacaugcuccggcuguucgacuucaacaagcaggcgauccgccggcugaagaccgaggcccagaugagcauccagcucaucaacaaggccgugaacgcccugaucaacgaccagcugaucaugaagaaccaccuccgcgacaucauggggauccccuacugcaacuacuccaaguacugguaccugaaccacacgaucaccggcaagaccagccugccccggugcuggcucgucuccaacggcagcuaccugaacgagacccacuucuccgacgacaucgagcagcaggccgacaacaugaucacggagcugcuccagaaggaguacauggaccgccaggggaagacgccccugggccugguggaccucuucguguucagcaccuccuucuaccugaucagcaucuuccugcaccuggucaagaucccgacccaccggcacaucaucgggaagcccugccccaagccccaccgccucaaccacaugggcaucugcuccugcgggcuguacaagcacccgggcgugcccgugcgguggaagcgcuga

SEQ ID NO: 846 - RNA, 1473 nt, Artificial Sequence
  derived and/or modified CDS sequence (opt1) from Lassa virus__AIT17458__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggcaagggguccugggacugcaucaugaccaccuaccaguaccucaucauccagaacaccacgugggaggaccacugccaguucagccgccccucccccaucggcuaccuggggcugcucagccagcggacccgcgacaucuacaucagccggcgccugcugggcaccuucaccuggacgcucuccgacagcgagggcaacgagacccccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagacggaggcccagauguccauccagcugaucaacaaggccgugaacgcccugaucaacgaccagcucaucaugaagaaccaccuccgggacaucaugggcauccccuacugcaacuacagcaaguacugguaccugaaccacaccgugaccgggaagaccucccugccccgcugcuggcuggucagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucguguucuccaccagcuucuaccugaucuccaucuuccugcaccucgucaagaucccgacgcaccgccacgugaucggcaagcccugccccaagccccaccggcugaaccacauggggaucugcagcugcggccuguacaagcacccgggggugcccgucaaguggaagcgcuga

SEQ ID NO: 847 - RNA, 1473 nt, Artificial Sequence
  derived and/or modified CDS sequence (opt1) from Lassa virus__AIT17462__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugcccaagugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcgguga

SEQ ID NO: 848 - RNA, 1473 nt, Artificial Sequence
  derived and/or modified CDS sequence (opt1) from Lassa virus__AIT17466__GPC
augggccagaucaucaccuucuuccaggaggugccccaggucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaaccaguccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuucgcgguggacgccgccaaccacugcgggaccaucgccaacggcguccugcagaccuucaugcggauggcguggggcggguccuacaucgcccuggacagcggccgcggguccugggacugcaucaugacgagcuaccaguaccucaucauccagaacaccaccugggaggaccacugccaguucucccggcccagccccaucggcuaccuggggcugcucagccagcgcacccgggacaucuacaucucccgccggcugcugggcacguucaccuggacccucagcgacuccgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccaucacggggaagaccagccugccccggugcuggcuggucuccaacggcagcuaccugaacgagacccacuucuccgacgacaucgagcagcaggccgacaacaugaucaccgagcuccugcagaaggaguacauggaccgccagggcaagacgccccuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcgguga

SEQ ID NO: 849 - RNA, 1473 nt, Artificial Sequence
  derived and/or modified CDS sequence (opt1) from Lassa virus__AIT17470__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccaccggaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcgguga

SEQ ID NO: 850 - RNA, 1473 nt, Artificial Sequence
  derived and/or modified CDS sequence (opt1) from Lassa virus__AIT17474__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccauccaguacaaccucagccacaccuacgcgguggacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacgaucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacaucacgggcaagcccugccccaagccccaccggcugaaccacauggggaucugcuccugcggccuguacaagcacccggggguccccgugcgcuggaagcgguga

SEQ ID NO: 851 - RNA, 1473 nt, Artificial Sequence
  derived and/or modified CDS sequence (opt1) from Lassa virus__AIT17478__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccgaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucagccggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggccgacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacgugaucggcaagcccugccccaagccccaccgccucaaccacauggggaucugcagcugcggccuguacaagcacccggggguccccgugaaguggaagcgguga

SEQ ID NO: 852 - RNA, 1473 nt, Artificial Sequence
  derived and/or modified CDS sequence (opt1) from Lassa virus__AIT17482__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaucaccugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggccgagcucaagugcuucgggaacacggccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgucaccgggaagacgagccugccccgcugcuggcugguguccaacggcagcuaccugaacgagacccacuucuccgacgacaucgagcagcaggcggacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacguggucggcaagcccugccccaagccccaccggcugaaccacauggggaucugcuccugcggccuguacaagcacccgggggugcccgugaaguggaagcgcuga

SEQ ID NO: 853 - RNA, 1473 nt, Artificial Sequence
  derived and/or modified CDS sequence (opt1) from Lassa virus__AIT17486__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccgugggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguacaagcacccgggggugcccgugaaguggaagcgcuga

SEQ ID NO: 854 - RNA, 1473 nt, Artificial Sequence
  derived and/or modified CDS sequence (opt1) from Lassa virus__AIT17490__GPC
augggccagaucaucaccuucuuccaggaggugccccacgucaucgaggaggugaugaacaucgugcugaucacccucagccugcuggccauccucaaggggaucuacaacgucgccacgugcggccuguucgggcugguguccuuccuccugcugugcggccgcagcugcuccaccaccuacaaggggguguacgagcuccagacccuggagcuggacauggcgaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuucgccguggacgcggccaaccacugcgggacgaucgccaacggcguccugcagaccuucaugcggauggccuggggcgggagcuacaucgcgcuggacuccggcaaggggagcugggacugcaucaugaccuccuaccaguaccucaucauccagaacaccacgugggaggaccacugccaguucagccgccccucccccaucggcuaccuggggcugcucagccagcggacccgcgacaucuacaucagccggcgccugcugggcaccuucaccuggacgcucuccgacagcgagggcaacgagacccccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagacggaggcgcagauguccauccagcugaucaacaaggccgugaacgcccugaucaacgaccagcucaucaugaagaaccaccuccgggacaucaugggcauccccuacugcaacuacagcaaguacugguaccugaaccacaccgucaccgggaagaccucccugccccgcugcuggcuggugagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucgucuucuccaccagcuucuaccugaucuccaucuuccugcaccucgugaagaucccgacgcaccgccacaucaucggcaagcccugccccaagccccaccggcugaaccacauggggaucugcagcugcggccuguacaagcacccgggggugcccgucaaguggaagcgcuga

SEQ ID NO: 855 - RNA, 1473 nt, Artificial Sequence
  derived and/or modified CDS sequence (opt1) from Lassa virus__AIT17494__GPC
augggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaucuacaagggggucuacgagcuccagacccuggagcuggacauggccagccucaacaugaccaugccgcuguccugcaccaagaacaacagccaccacuacaucauggugggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagaccuucaugcggauggcguggggcggguccuacaucgcccuggacagcggcaagggguccugggacugcaucaugacgagcuaccaguaccucaucauccagaacaccuccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacaccgugaccgggaagacgucccugccccgcugcuggcuggugagcaacggcuccuaccugaacgagacccacuucagcgacgacaucgagcagcaggccgacaacaugaucaccgagcuccugcagaaggaguacaucgaccggcagggcaagaccccgcuggggcucgucgaccuguucguguucuccacgagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcuga

SEQ ID NO: 856 - RNA, 1473 nt, Artificial Sequence
  derived and/or modified CDS sequence (opt1) from Lassa virus__AIT17498__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgagaccgagcucaagugcuucgggaacaccgccguggccaagugcaacgagaagcacgacgaggaguucugcgacaugcugcgccuguucgacuucaacaagcaggccaucucccggcuccgcagcgaggcgcagauguccauccagcugaucaacaaggccgugaacgcccugaucaacgaccagcucaucaugaagaaccaccuccgggacaucaugggcauccccuacugcaacuacagcaaguacugguaccugaaccacacggucaccgggaagaccucccugcccaagugcuggcuggugagcaacggcuccuaccugaacgagacccacuucagcgacgacaucgagcagcaggccgacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacaucacgggcaagcccugccccaagccccaccgccucaaccacauggggaucugcagcugcggccuguacaagcacccgggggugcccgucaaguggaagcgguga

SEQ ID NO: 857 - RNA, 1473 nt, Artificial Sequence
  derived and/or modified CDS sequence (opt1) from Lassa virus__AIT17502__GPC
augggccagaucaucaccuucuuccaggagaucccccacgugaucgaggaggucaugaacaucgugcugaucacccucagccugcuggccauccucaaggggaucuacaacguggccacgugcggccuguucgggcuggucuccuuccuccugcugugcggcaagagcugcuccaccaccuacaaggggguguacgagcuccagacccuggagcuggacauggcgagccucaacaugacgaugccgcuguccugcaccaagaacaacagccaccacuacaucauggugggcaacgagaccggccuggagcucacccugacgaacaccuccaucaucaaccacaaguucugcaaccugagcgacgcccaccgcaagaaccucuacgaccacacccugauguccaucaucagcaccuuccaccuguccauccccaacuucaaccaguacgaggccaugagcugcgacuucaacgggggcaagaucuccguccaguacaaccucagccacgccuacgccaucgacgcggccacgcacugcgggaccaucgccaacggcgugcugcagaccuucaugcggauggccuggggcggguccuacaucgcgcuggacagcggcaagggcgggugggacugcaucaugaccuccuaccaguaccucaucauccagaacacgaccugggaggaccacugccaguucagccgccccucccccaucggguaccugggccugcucagccagcggacccgcgacaucuacaucagccggcgccugcugggcaccuucacguggacccucuccgacagcgaggggaacgagaccccgggcggguacugccugacccgguggaugcugaucgaggccgagcucaagugcuucggcaacacggccguggccaagugcaacgagaagcacgacgaggaguucugcgacaugcugcgccuguucgacuucaacaagcaggccauccggcgccucaagaccgaggcgcagauguccauccagcugaucaacaaggccgucaacgcccugaucaacgaccagcucaucaugcggaaccaccuccgcgacaucauggggauccccuacugcaacuacagcaaguacugguaccugaaccacaccgugaccggcaagacgucccugcccaagugcuggcuggugagcaacggcuccuaccugaacgagacccacuucagcgacgacaucgagcagcaggccgacaacaugaucaccgagcuccugcagaaggaguacauggaccggcaggggaagacgccccugggccucgucgaccuguucguguucuccaccagcuucuaccugaucuccaucuuccugcaccucgugaagaucccgacccaccgccacgucaucgggaagcccugccccaagccccaccggcugaaccacaugggcgugugcagcugcgggcuguacaagcacccgggcgugcccgucaaguggaagcgcuga

SEQ ID NO: 858 - RNA, 1473 nt, Artificial Sequence
  derived and/or modified CDS sequence (opt1) from Lassa virus__AIT17506__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccgagcacugcgggaccaucgcgaacggcguccugcagaccuucaugcggauggccuggggcggguccuacaucgcccuggacagcggcaagggguccugggacugcgugaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccaucgagcggcucaagaccgaggcccagaugagcauccagcugaucaacaaggccgucaacgcccugaucaacgaccagcucaucaugaagaaccaccuccgcgacaucaugggcaucccguacugcaacuacuccaaguacugguaccugaaccacaccgugacggggaagaccagccugccccggugcuggcugguguccaacggcagcuaccugaacgagacccacuucuccgacgacaucgagcagcaggcggacaacaugaucaccgagaugcuccagaaggaguacaucgaccgccagggcaagacgccccuggggcuggucgaccucuucguguucagcaccuccuucuaccugaucagcaucuuccugcaccuggugaagaucccgacccaccggcacgucaucggcaagcccugccccaagccccaccgccucaaccacauggggaucugcuccugcggccuguacaagcacccgggggugcccgugaaguggaagcgguga

SEQ ID NO: 859 - RNA, 1473 nt, Artificial Sequence
  derived and/or modified CDS sequence (opt1) from Lassa virus__AIT17510__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgaaggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcgguga

SEQ ID NO: 860 - RNA, 1473 nt, Artificial Sequence
  derived and/or modified CDS sequence (opt1) from Lassa virus__AIT17514__GPC
augggccagaucaucaccuucuuccaggaggugccccacgucaucgaggaggugaugaacaucgugcugaucgcccucagccugcuggccguccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucgucgaccuguucguguucagcaccuccuucuaccugaucagcaucuuccugcaccucgugaagaucccgacccaccgccacgucaucggcaagcccugccccaagccccaccggcugaaccacauggggaucugcuccugcggccuguaccgccacccgggggugcccgugaaguggaagcgguga

SEQ ID NO: 861 - RNA, 1473 nt, Artificial Sequence
  derived and/or modified CDS sequence (opt1) from Lassa virus__AIT17518__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcuga

SEQ ID NO: 862 - RNA, 1473 nt, Artificial Sequence
  derived and/or modified CDS sequence (opt1) from Lassa virus__AIT17524__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggugaccgggaagaccagccugccccgcugcuggcuggucuccaacggcagcuaccugaacgagacccacuucuccgacgacaucgagcagcaggccgacaacaugaucacggagaugcuccagaaggaguacauggaccggcagggcaagaccccgcuggggcugguggaccucuucguguucagcaccuccuucuaccugaucagcaucuuccugcaccuggucaagaucccgacccaccgccacgugaucggcaagcccugccccaagccccaccggcucaaccacauggggaucugcuccugcggccuguacaagcacccgggggugcccgucaaguggaagcgcuga

SEQ ID NO: 863 - RNA, 1473 nt, Artificial Sequence
  derived and/or modified CDS sequence (opt1) from Lassa virus__AIT17528__GPC
augggccagaucaucaccuucuuccaggaggugccccacgucaucgaggaggugaugaacaucgugcugaucgcccucagccugcuggccaugcucaaggggaucuacaacaucgcgaccugcggccuguucgggcugaucuccuuccuccugcugugcggccgcagcugcuccacgaccuacaagggggucuacgagcuccaggcccuggagcuggacauggccaaccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggcgauguccugcgacuucaacgggggcaagaucagcgugcaguacaaccucucccacaccuacgccggggacgccgccaagcacugcggcaccaucgcgaacgggguccugcagaccuucaugcggauggccuggggcggcagcuacaucgcccuggacuccgggaagggcaacugggacugcaucaugacgagcuaccaguaccucaucauccagaacaccaccugggaggaccacugccaguucucccgccccagccccaucggguaccugggccugcucucccagcggacccgcgacaucuacaucagccggcgccugcugggcacguucaccuggacccucagcgacuccgaggggaacgagaccccgggcggguacugccugacgcgguggaugcugaucgaggccgagcucaagugcuucggcaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucauggggauccccuacugcaacuacuccaaguacugguaccugaaccacagcgucaccggccgcacgucccugccccggugcuggcuggugagcaacggcuccuaccugaacgagacccaguucagcgacgacaucgagcagcaggcggacaacaugaucaccgagaugcuccagaaggaguacaucgaccgccaggggaagacgccccugggccugguggaccucuucgucuucuccaccagcuucuaccugaucuccaucuuccugcaccugaucaagaucccgacccaccggcacaucguggggaagcccugccccaagccccaccgccucaaccacaugggcaucugcagcugcgggcuguacaagcacccgggcauccccgugaaguggaagcgguga

SEQ ID NO: 864 - RNA, 1473 nt, Artificial Sequence
  derived and/or modified CDS sequence (opt1) from Lassa virus__AIT17538__GPC
augggccagaucaucaccuucuuccaggaggugccccacgucaucgaggaggugaugaacaucgugcugaucgcccucagccugcuggccauccucaaggggaucuacaacaucgcgaccugcggccuguucgggcugaucuccuuccuccugcugugcggccgcagcugcuccacgaccuacaagggggucuacgagcuccagacccuggagcuggacauggccaaccucaacaugaccaugccgcugagcugcacgaagaacaacucccaccacuacaucauggugggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgaggggaagaucagcgugcaguacaaccucucccacagcuacgcgaucgacgccgccggccacugcgggaccaucgccaacggcguccugcagaccuucaugcggauggcguggggcggguccuacaucgcccuggacagcggcaaggggaacugggacugcaucaugacguccuaccaguaccucaucauccagaacaccaccugggaggaccacugccaguucagccgccccucccccaucggcuaccuggggcugcucagccagcggacccgcgacaucuacaucagccggcgccugcugggcacguucaccuggacccucuccgacagcgagggcaacgaggcccccgggggcuacugccugacccgguggaugcugaucgaggccgagcucaagugcuucgggaacacggccaucgcgaagugcaacgagaagcacgacgaggaguucugcgacaugcugcgccuguucgacuucaacaagcaggccaucaagcggcucaaggccgaggcccagauguccauccaccugaucaacaaggccgugaacgcgcugaucaacgaccagcucaucaugaagaaccaccuccgcgacaucaugggcauccccuacugcaacuacagcaaguacugguaccugaaccacaccgugaccgggaagaccucccugcccaagugcuggcuggucagcaacggcuccuaccugaacgagacgcacuucagcgacgacaucgagcagcaggccgacaacaugaucaccgagcuccugcagaaggaguacauggaccggcagggcaagaccccgcuggggcucguggaccuguucguguucuccaccagcuucuaccugaucuccaucuuccugcaccucgucaagaucccgacgcaccgccacaucgugggccggcccugccccaagccccaccgccugaaccacauggggaucugcagcugcggccuguacaagcacccgggggugcccgucaaguggaagcgguga

SEQ ID NO: 865 - RNA, 1473 nt, Artificial Sequence
  derived and/or modified CDS sequence (opt1) from Lassa virus__AIT17540__GPC
augggccagaucgugaccuucuuccaggaggucccccacgugaucgaggagaucaugaacaucgugcugaucacccucagccugcuggccauccucaaggggaucuacaacuucgccacgugcggccugaucgggcugaucaccuuccucuuccugugcggccgcuccugcagcaccaucuacaagggguccuaccagcugcagacccucgagcugaacauggagacgcugaacaugaccaugccgcucagcugcaccaagaacaacucccaccacuacauccgggucggcaacgagaccggccuggagcugacgcucaccaacaccagcaucaucaaccacaaguucugcaaccuguccgaggcgcacaagaagaaccuguacgaccacgcccucaugagcaucaucuccaccuuccaccugagcauccccaacuucaaccaguacgaggccauguccugcgacuucaacgggggcaagaucagcgugcaguacaaccugucccacagcuacgccguggacgccgcgaaccacugcgggacggucgccaacggcgugcuccagaccuucaugcgcauggccuggggcggguccuacaucgcccuggacagcggccgggggaacugggacugcaucaugaccuccuaccaguaccugaucauccagaacaccacgugggaggaccacugccaguucagccgccccucccccaucggcuaccucgggcugcugagccagcggacccgcgacaucuacaucagccggcgccuccugggcaccuucaccuggacgcuguccgacagcgagggcaaggagacccccgggggcuacugccucacccgguggaugcugaucgaggcggagcugaagugcuucgggaacaccgccguggccaagugcaacgagaagcacgacgaggaguucugcgacaugcuccgccuguucgacuucaacaagcaggccauccagcggcugaagacggaggcccagauguccauccagcucaucaacaaggcggucaacgcccugaucaacgaccagcugaucaugaagaaccaccuccgcgacaucaugggcauccccuacugcaacuacagcaaguacugguaccugaaccacaccuccaccgggcggaccagccugcccaagugcuggcucguguccaacggcagcuaccugaacgagacgcacuucuccgacgacaucgagcagcaggccgacaacaugaucaccgagaugcugcagaaggaguacaucgaccgccagggcaagaccccgcucgggcugguggaccuguucgucuucagcaccuccuucuaccucaucagcaucuuccugcaccuggugaagaucccgacgcaccggcacaucgugggcaaguccugccccaagccccaccgccugaaccacauggggaucugcagcugcggccucuacaagcagcccggggucccggugaaguggaagcgguga

SEQ ID NO: 866 - RNA, 1473 nt, Artificial Sequence
  derived and/or modified CDS sequence (opt1) from Lassa virus__AIT17544__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugggcagccucaacaugaccaugccgcuguccugcacgaagaacaacagccaccacuacaucauggucggcaacgagaccgggcuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacggcgggaagaucuccgugcaguacaaccucagccacuccuacgccguggacgcggccaaccacugcggcaccaucgccaacgggguccugcagaccuucaugcggauggccuggggcggcagcuacaucgcgcuggacuccgggaagggcagcugggacugcaucaugacguccuaccaguaccucaucauccagaacaccaccugggaggaccacugccaguucagccgccccagccccaucggguaccugggccugcucucccagcggacccgcgacaucuacaucagccggcgccugcugggcacguucaccuggacccucuccgacagcgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggccauccggcgccucaagaccgaggcgcagauguccauccagcugaucaacaaggccgugaacgcccugaucaacgaccagcucaucaugaagaaccaccuccgggacaucauggggauccccuacugcaacuacagcaaguacugguaccugaaccacaccgucacgggcaagaccucccugccccgcugcuggcuggugagcaacggcuccuaccugaacgagacccacuucagcgacgacaucgagcagcaggccgacaacaugaucaccgagcuccugcagaaggaguacauggaccggcaggggaagacgccccugggccucguggaccuguucgucuucuccaccagcuucuaccugaucuccaucuuccugcaccucgugaagaucccgacccaccgccacaucaucgggaagcccugccccaagccccaccggcugaaccacaugggcaucugcagcugcgggcuguacaagcacccgggcgugcccgucaaguggaagcgcuga

SEQ ID NO: 867 - RNA, 1473 nt, Artificial Sequence
  derived and/or modified CDS sequence (opt1) from Lassa virus__AIT17548__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccucuuccugugcggccgcagcugcuccacgaccuacaaggggguguacgagcugcagacccucgagcuggacauggccagccugaacaugaccaugccgcucuccugcacgaagaacaacagccaccacuacaucauggucggcaacgagaccggccuggagcugacccucaccaacacguccaucaucaaccacaaguucugcaaccugagcgacgcccacaagcggaaccuguacgaccacgcccucauguccaucaucagcaccuuccaccuguccauccccaacuucaaccaguacgaggccaugagcugcgacuucaacgggggcaagaucuccgugcaguacaaccugagccacgcguacgccggggacgccgccaagcacugcggcaccaucgcgaacggggugcuccagaccuucaugcgcauggccuggggcggcuccuacaucgcccuggacagcgggaagggcuccugggacugcaucaugacgagcuaccaguaccugaucauccagaacaccaccugggaggaccacugccaguucucccggcccagccccaucggguaccucggccugcugagccagcgcacccgggacaucuacaucucccgccggcuccugggcacguucaccuggacccugagcgacuccgaggggaacgagaccccgggcggguacugccucacgcgcuggaugcugaucgaggccgagcugaagugcuucggcaacaccgccgucgcgaagugcaacgagaagcacgacgaggaguucugcgacaugcuccggcuguucgacuucaacaagcaggccauccgccggcugcgcaccgaggcccagaugagcauccagcucaucaacaaggccgugaacgcccugaucaacgaccagcugaucaugaagaaccaccuccgggacaucauggggauccccuacugcaacuacuccaaguacugguaccugaaccacaccgugacgggcaagaccagccugcccaagugcuggcucgucuccaacggcagcuaccugaacgagacccacuucuccgacgacaucgagcagcaggcggacaacaugaucaccgagaugcugcagaaggaguacaucgaccgccaggggaagacgccccucggccugguggaccuguucguguucagcaccuccuucuaccucaucagcaucuuccugcaccuggucaagaucccgacccaccggcacgugaucgggaagcccugccccaagccccaccgccugaaccacaugggcaucugcuccugcgggcucuacaagcacccgggcgugcccgucaaguggaagcgguga

SEQ ID NO: 868 - RNA, 1473 nt, Artificial Sequence
  derived and/or modified CDS sequence (opt1) from Lassa virus__AIT17552__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccgugaacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacauggaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagaaguga

SEQ ID NO: 869 - RNA, 1473 nt, Artificial Sequence
  derived and/or modified CDS sequence (opt1) from Lassa virus__AIT17556__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggccgcggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacgaucaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacaucacgggcaagcccugccccaagccccaccgccugaaccacauggggaucugcuccugcggccuguacaagcacccgggggugcccgugcgguggaagcgcuga

SEQ ID NO: 870 - RNA, 1473 nt, Artificial Sequence
  derived and/or modified CDS sequence (opt1) from Lassa virus__AIT17560__GPC
augggccagaucaucaccuucuuccaggaggugccccacgucaucgaggaggugaugaacaucgugcugaucgcccucagccugcuggccguccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaccaacaacagccaccacuacaucauggugggcaacgagaccggccuggagcucacccugacgaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccggggaggccgccaaccacugcggcaccaucgcgaacgggguccugcagacguucaugcggauggccuggggcggcuccuacaucgcccuggacagcgggaagggcuccugggacugcaucaugaccagcuacaaguaccucaucauccagaacaccaccuggggcgaccacugccaguucucccgccccagccccaucggguaccugggccugcucagccagcggacgcgcgacaucuacaucucccggcgccugcuggggaccuucaccuggacccucagcgacuccgagggcaacgagacgcccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccauccggaagcucaagaccgaggcccagaugagcauccagcugaucaacaaggccgugaacgcccugaucaacgaccagcucaucaugaagaaccaccuccgcgacaucaugggcauccccuacugcaacuacucccgguacugguaccugaaccacacggucaccggccgcaccagccugccccggugcuggcugguguccaacgggagcuaccugaacgagacccacuucuccgacgacaucgagcagcaggcggacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggcgugcccgucaaguggaagcgguga

SEQ ID NO: 871 - RNA, 1473 nt, Artificial Sequence
  derived and/or modified CDS sequence (opt1) from Lassa virus__AIT17564__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugcucuccuuccugcugcucugcggccgcagcugcuccacgaccuacaaggggguguacgagcugcagacccuggagcucgacauggccagccugaacaugaccaugccgcuguccugcacgaagaacaacagccaccacuacaucauggugggcaacgagaccggccucgagcugacccugaccaacacguccaucaucaaccacaaguucugcaaccucagcgacgcccacaagaaggaccuguacgaccacgcccugauguccaucaucagcaccuuccaccucuccauccccaacuucaaccaguacgaggccaugagcugcgacuucaacgggggcaagaucuccguccaguacaaccugagccacgcguacgccguggacgccgccaagcacugcgggaccaucgcgaacggcgugcugcagaccuucaugcggauggccuggggcggguccuacaucgcccucgacagcggcaagggguccugggacugcaucaugacgagcuaccaguaccugaucauccagaacaccuccugggaggaccacugccaguucagccgccccagccccaucggcuaccuggggcuccugucccagcggacccgcgacaucuacaucagccggcgccugcucggcaccuucacguggacccuguccgacagcgagggcaacgagacccccgggggcuacugccugacccgguggaugcucaucgaggccgagcugaagugcuucgggaacacggccgucgcgaagugcaacgagaagcacgacgaggaguucugcgacaugcugcgccucuucgacuucaacaagcaggccaucaagcggcugaagaccgaggcccagauguccauccagcugaucaacaaggccgugaacgcccucaucaacgaccagcugaucaugaagaaccaccuccgcgacaucaugggcauccccuacugcaacuacagcaaguacugguaccugaaccacaccgugaccgggaagacgucccugccccggugcuggcuggucagcaacggcuccuaccucaacgagacccacuucagcgacgacaucgagcagcaggcggacaacaugaucaccgagcugcugcagaaggaguacaucgaccgccagggcaagaccccgcucgggcugguggaccuguucguguucuccacgagcuucuaccugaucuccaucuuccuccaccuggucaagaucccgacccaccggcacgugaucggcaagcccugccccaagccccaccgccugaaccacauggggaucugcagcugcggccucuacaagcacccgggggugcccgucaaguggaagcgguga

SEQ ID NO: 872 - RNA, 1473 nt, Artificial Sequence
  derived and/or modified CDS sequence (opt1) from Lassa virus__AIT17572__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaacuacgcgguggacgccgccaaccacugcgggaccaucgccaacggcguccugcagaccuucaugcggauggcguggggcgggagcuacaucgcccuggacuccggcaaggggaacugggacugcaucaugacgagcuaccaguaccucaucauccagaacaccaccugggaggaccacugccaguucucccgccccagccccaucggcuaccuggggcugcucucccagcggacccgcgacaucuacaucagccggcgccugcugggcacguucaccuggacccucagcgacuccgagggcaacgacaugcccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagaugaacauccagcugaucaacaaggccgugaacgcccugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacaucaucggcaagcccugccccaagccccaccggcugaaccacauggggaucugcagcugcggccuguacaagcacccgggggugcccgucaaguggaagcgcuga

SEQ ID NO: 873 - RNA, 1473 nt, Artificial Sequence
  derived and/or modified CDS sequence (opt1) from Lassa virus__AIT17576__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucucccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagaugcuccagaaggaguacaucgaccgccagggcaagaccccgcuggggcugguggaccucuucgucuucagcaccuccuucuaccugaucagcaucuuccugcaccuggugaagaucccgacccaccggcacaucacgggcaagcccugccccaagccccaccgccucaaccacauggggaucugcuccugcggccuguacaagcacccgggggugcccgucaaguggaagcgguga

SEQ ID NO: 874 - RNA, 1473 nt, Artificial Sequence
  derived and/or modified CDS sequence (opt1) from Lassa virus__AIT17580__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagagcaacgagacgccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggcgauccggcgccucaaggccgaggcccagauguccauccagcugaucaacaaggccgugaacgcccugaucaacgaccagcucaucaugaagaaccaccuccgggacaucauggggauccccuacugcaacuacagcaaguacugguaccugaaccacaccgucacgggccgcaccucccugccccggugcuggcuggugagcaacggguccuaccugaacgagacccacuucagcgacgacaucgagcagcaggcggacaacaugaucaccgagcuccugcagaaggaguacauggaccgccagggcaagacgccccugggccucguggaccuguucgucuucuccaccagcuucuaccugaucuccaucuuccugcaccucgugaagaucccgacccaccggcacgugaucgggaagcccugccccaagccccaccgccugaaccacaugggcaucugcagcugcgggcuguacaagcacccgggcguccccgugaaguggaagcgguga

SEQ ID NO: 875 - RNA, 1473 nt, Artificial Sequence
  derived and/or modified CDS sequence (opt1) from Lassa virus__AIT17584__GPC
augggccagaucaucaccuucuuccaggaggugccccaggucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaaccaguccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacuccuucgcgguggacgccgccaaccacugcgggaccaucgccaacggcguccugcagaccuucaugcggauggcguggggcgggagcuacaucgcccuggacuccggcaaggggagcugggacugcaucaugaccuccuaccaguaccucaucauccagaacacgaccugggaggaccacugccaguucagccgccccagccccaucggcuaccuggggcugcucucccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucaugggcauccccuacugcaacuacagcaaguacugguaccugaaccacaccaagaccgggaagacgucccugccccgcugcuggcuggucagcaacggcuccuaccugaacgagacccacuucagcgacgacaucgagcagcaggccgacaacaugaucaccgagcuccugcagaaggaguacauggaccggcagggcaagaccccgcuggggcucguggaccuguucguguucuccacgagcuucuaccugaucuccaucuuccugcaccucgucaagaucccgacccaccgccacgugaucggcaagcccugccccaagccccaccggcugaaccacauggggaucugcagcugcggccuguacaagcacccgggggugcccgucaaguggaagcgcuga

SEQ ID NO: 876 - RNA, 1473 nt, Artificial Sequence
  derived and/or modified CDS sequence (opt1) from Lassa virus__AIT17588__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaaggccgaggcccagaugagcauccagcugaucaacaaggccgugaacgcgcugaucaacgaccagcucaucaugaagaaccaccuccgggacaucaugggcauccccuacugcaacuacuccaaguacugguaccugaaccacaccgucaccgggaagacgagccugccccgcugcuggcugguguccaacggcagcuaccugaacgagacccacuucuccgacgacaucgagcagcaggccgacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcuga

SEQ ID NO: 877 - RNA, 1473 nt, Artificial Sequence
  derived and/or modified CDS sequence (opt1) from Lassa virus__AIT17592__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacacccugauguccaucaucagcaccuuccaccuguccauccccaacuucaaccaguacgaggccaugagcugcgacuucaacgggggccggaucuccgugcaguacaaccucagccacgccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacgaucaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacguggugggcaagcccugccccaagccccaccgccugaaccacauggggaucugcuccugcggccuguacaagcacccggggguccccgugaaguggaagcgguga

SEQ ID NO: 878 - RNA, 1473 nt, Artificial Sequence
  derived and/or modified CDS sequence (opt1) from Lassa virus__AIT17596__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccuccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucaugggcaucccguacugcaacuacagcaaguacugguaccugaaccacaccgucacggggaagaccucccugccccgcugcuggcuggugagcaacggcuccuaccugaacgagacccacuucagcgacgacaucgagcagcaggccgacaacaugaucaccgagcuccugcagaaggaguacaucgaccggcagggcaagacgccccuggggcucguggaccuguucgucuucuccaccagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcuga

SEQ ID NO: 879 - RNA, 1473 nt, Artificial Sequence
  derived and/or modified CDS sequence (opt1) from Lassa virus__AIT17600__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccggggacgccgccaaccacugcggcaccaucgcgaacggggugcugcagaccuucaugcggauggccuggggcggcuccuacaucgcccuggacagcgggaagggcuccugggacugcaucaugacgagcuaccaguaccucaucauccagaacaccaccugggaggaccacugccaguucucccgccccagccccaucggguaccugggccugcucagccagcggacccgcgacaucuacaucucccggcgccugcugggcacguucaccuggacccucagcgacuccgaggggaacgagaccccgggcggguacugccugacgcgguggaugcugaucgaggccgagcucaagugcuucggcaacaccgccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucauggggauccccuacugcaacuacuccaaguacugguaccugaaccacaccgugacgggcaagaccagccugccccgcugcuggcuggucuccaacggcagcuaccugaacgagacccacuucuccgacgacaucgagcagcaggcggacaacaugaucaccgagcuccugcagaaggaguacaucgaccggcaggggaagacgccccugggccucguggaccuguucguguucagcaccuccuucuaccugaucagcaucuuccugcaccucgucaagaucccgacccaccgccacgugaucgggaagcccugccccaagccccaccggcugaaccacaugggcaucugcuccugcgggcuguacaagcacccgggcgugcccgucaaguggaagcgcuga

SEQ ID NO: 880 - RNA, 1473 nt, Artificial Sequence
  derived and/or modified CDS sequence (opt1) from Lassa virus__AIT17604__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccagccucaacaugacgaugccgcuguccugcaccaagaacaacagccaccacuacaucauggucggcaacgagaccggccuggagcucacccugacgaacaccuccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgccguggacgcggccaagcacugcgggacgaucgccaacggcguccugcagaccuucaugcggauggccuggggcggguccuacaucgcgcuggacagcggcaagggguccugggacugcaucaugaccagcuaccaguaccucaucauccagaacaccacgugggaggaccacugccaguucucccgccccagccccgugggcuaccuggggcugcucagccagcggacccgcgacaucuacaucucccggcgccugcugggcaccuucaccuggacgcucagcgacuccgagggcaacgagacccccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagacggaggcgcagaugagcauccagcugaucaacaaggccgucaacgcccugaucaacgaccagcucaucaugaagaaccaccuccgggacaucaugggcauccccuacugcaacuacuccaaguacugguaccugaaccacaccgugaccgggaagaccagccugccccgcugcuggcugguguccaacggcagcuaccugaacgagacgcacuucuccgacgacaucgagcagcaggccgacaacaugaucaccgagcuccugcagaaggaguaccuggaccggcagggcaagaccccgcucgggcuggucgaccuguucguguucagcaccuccuucuaccugaucagcaucuuccuccaccuggugaagaucccgacgcaccgccacgucaucggcaagcccugccccaagccccaccggcugaaccacauggggaucugcuccugcggccucuacaagcacccgggggugcccgugaaguggaagcgcuga

SEQ ID NO: 881 - RNA, 1473 nt, Artificial Sequence
  derived and/or modified CDS sequence (opt1) from Lassa virus__AIT17608__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacaaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggcggcgcuga

SEQ ID NO: 882 - RNA, 1473 nt, Artificial Sequence
  derived and/or modified CDS sequence (opt1) from Lassa virus__AIT17612__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacauccgggucggcaacgagaccggccuggagcucacccugaccaacacguccaucaucaaccacaaguucugcaaccugagcgacgcccacaagaagaaccucuacgaccacucccugaugagcaucaucuccaccuuccaccugagcauccccaacuucaaccaguacgaggccauguccugcgacuucaacgggggcaagaucagcgugcaguacaaccucucccacaccuacgccguggacgcggccaaccacugcgggaccaucgccaacggcguccugcagacguucaugcgcauggccuggggcgggagcuacaucgcgcuggacuccggcaaggggaacugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggccauccgccggcucaagaccgaggcgcagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacguggucggcaagcccugccccaagccccaccgccugaaccacauggggaucugcuccugcggccuguacaagcacccgggggugcccgugaaguggaagcgguga

SEQ ID NO: 883 - RNA, 1473 nt, Artificial Sequence
  derived and/or modified CDS sequence (opt1) from Lassa virus__AIT17616__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccaaccacugcgggaccaucgcgaacggcguccugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggcggacaacaugaucaccgagcuccugcagaaggaguacaucgaccggcagggcaagacgccccuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcuga

SEQ ID NO: 884 - RNA, 1473 nt, Artificial Sequence
  derived and/or modified CDS sequence (opt1) from Lassa virus__AIT17620__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucagccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacgcguacgccaucgacgccgccaaccacugcgggaccguggcgaacggcguccugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaaggccgaggcccagauguccauccagcugaucaacaaggccgugaacgcgcugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggccuguacaagcacccggggguccccgugaaguggaagcgcuga

SEQ ID NO: 885 - RNA, 1473 nt, Artificial Sequence
  derived and/or modified CDS sequence (opt1) from Lassa virus__AIT17626__GPC
augggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucauccagcacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucaccgugcaguacaaccucucccacagcuacgcgaucgacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggcgcaccagccugccccggugcuggcugguguccaacggcagcuaccugaacgagacccacuucuccgacgacaucgagcagcaggccgacaacaugaucacggagcuccugcagaaggaguacauggaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacaugggggugugcuccugcggccuguacaagcacccggggguccccgugaaguggaagcgguga

SEQ ID NO: 886 - RNA, 1473 nt, Artificial Sequence
  derived and/or modified CDS sequence (opt1) from Lassa virus__AIT17630__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugcucuccuuccugcugcucugcggccgcagcugcuccacgaccuacaaggggguguacgagcugcagacccuggagcucgacauggccagccugaacaugaccaugccgcuguccugcacgaagaacaacagccaccacuacaucauggugggcaacgagaccggccucgagcugacccugaccaacacguccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacgcguacgccguggacgccgccgagcacugcgggaccaucgcgaacggcgugcugcagaccuucaugcggauggccuggggcggguccuacaucgcccucgacagcggcaagggguccugggacugcgucaugacgagcuaccaguaccugaucauccagaacaccuccugggaggaccacugccaguucagccgccccagccccaucggcuaccuggggcuccugucccagcggacccgcgacaucuacaucagccggcgccugcucggcaccuucacguggacccuguccgacagcgagggcaacgagacccccgggggcuacugccugacccgguggaugcucaucgaggccgagcugaagugcuucgggaacacggccguggcgaagugcaacgagaagcacgacgaggaguucugcgacaugcugcgccucuucgacuucaacaagcaggccauccggcgccugaagaccgaggcccagauguccauccagcugaucaacaaggccgugaacgcccucaucaacgaccagcugaucaugaagaaccaccuccgggacaucaugggcauccccuacugcaacuacagcaaguacugguaccugaaccacaccgucaccgggaagacgucccugccccgcugcuggcuggugagcaacggcuccuaccucaacgagacccacuucagcgacgacaucgagcagcaggcggacaacaugaucaccgagcugcugcagaaggaguacaucgaccggcagggcaagaccccgcucgggcugguggaccuguucgucuucuccacgagcuucuaccugaucuccaucuuccuccaccuggugaagaucccgacccaccgccacgugaucggcaagcccugccccaagccccaccggcugaaccacauggggaucugcagcugcggccucuacaagcacccggggguccccgugaaguggaagcgcuga

SEQ ID NO: 887 - RNA, 1473 nt, Artificial Sequence
  derived and/or modified CDS sequence (opt1) from Lassa virus__AIT17634__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaucuacaaggacguguacgagcuccagacccuggagcuggacauggccagccucaacaugaccaugccgcuguccugcaccaagaacaacagccaccacuacaucauggucgggaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacggcgggaagaucuccgugcaguacaaccucagccacaccuacgcgaucgacgccgccaaccacugcggcaccaucgccaacggggugcugcagaccuucaugcggauggcguggggcggguccuacaucgcccuggacagcggcaagggcuccugggacugcaucaugacgagcuaccaguaccucaucauccagaacaccaccugggaggaccacugccaguucucccgccccagccccaucggguaccugggccugcucagccagcggacccgcgacaucuacaucucccggcgccugcuggggacguucaccuggacccucagcgacuccgagggcaacgagaccccgggcggguacugccugacgcgguggaugcugaucgaggccgagcucaagugcuucggcaacaccgccgucgccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucauggggauccccuacugcaacuacucccgcuacugguaccugaaccacaccgugacgggccggaccagccugccccgcugcuggcuggucuccaacgggagcuaccugaacgagacccacuucuccgacgacaucgagcagcaggccgacaacaugaucaccgagcuccugcagaaggaguacauggaccggcagggcaagacgccccugggccucguggaccuguucguguucagcaccuccuucuaccugaucagcaucuuccugcaccucgucaagaucccgacccaccgccacgugaucgggaagcccugccccaagccccaccggcugaaccacaugggcaucugcuccugcgggcuguacaaccacccgggcgugcccgucaaguggaagcgcuga

SEQ ID NO: 888 - RNA, 1473 nt, Artificial Sequence
  derived and/or modified CDS sequence (opt1) from Lassa virus__AIT17638__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucaucaagaucccgacccaccgccacaucacgggcaagcccugccccaagccccaccggcugaaccacauggggaucugcuccugcggccuguacaagcacccgggggugcccgugaaguggaagcgcuga

SEQ ID NO: 889 - RNA, 1473 nt, Artificial Sequence
  derived and/or modified CDS sequence (opt1) from Lassa virus__AIT17642__GPC
augggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgacaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccgucgacgccgccucccacugcgggaccaucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggaagaccucccugccccgcugcuggcuggugagcaacggcuccuaccugaacgagacccacuucagcgacgacaucgagcagcaggcggacaacaugaucaccgagcuccugcagaaggaguacauggaccggcagggcaagacgccccuggggcucgucgaccuguucguguucuccaccagcuucuaccugaucuccaucuuccugcaccucgugaagaucccgacccaccgccacaucaucggcaagcccugccccaagccccaccggcugaaccacauggggaucugcagcugcggccuguacaagcacccggggguccccgugaaguggaagcgcuga

SEQ ID NO: 890 - RNA, 1473 nt, Artificial Sequence
  derived and/or modified CDS sequence (opt1) from Lassa virus__AIT17646__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccucccacugcgggaccgucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggaagaccucccugccccgcugcuggcuggugagcaacggcuccuaccugaacgagacccacuucagcgacgacaucgagcagcaggcggacaacaugaucaccgagcuccugcagaaggaguacauggaccggcagggcaagacgccccuggggcucgucgaccuguucguguucuccaccagcuucuaccugaucuccaucuuccugcaccucgugaagaucccgacccaccgccacgucaucggcaagcccugccccaagccccaccggcugaaccacauggggaucugcagcugcggccuguacaagcacccgggggugcccgugaaguggaagcgcuga

SEQ ID NO: 891 - RNA, 1473 nt, Artificial Sequence
  derived and/or modified CDS sequence (opt1) from Lassa virus__AIT17650__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacaucuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaaggccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgucaccgggcgcacgagccugccccggugcuggcugguguccaacggcagcuaccugaacgagacccacuucuccgacgacaucgagcagcaggcggacaacaugaucaccgagcuccugcagaaggaguacaucgaccgccagggcaagaccccgcuggggcucguggaccuguucgucuucagcacguccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcgguga

SEQ ID NO: 892 - RNA, 1473 nt, Artificial Sequence
  derived and/or modified CDS sequence (opt1) from Lassa virus__AIT17658__GPC
augggccagaucaucaccuucuuccaggaggugccccacgucaucgaggaggugaugaacaucgugcugaucgcccucagccugcuggccauccucaagggggucuacaacguggcgaccugcggccuguucgggcugguguccuuccuccugcugugcggccgcagcugcuccaucacguacaagggggucuacgagcuccagacccuggagcuggacauggccaaccucaacaugaccaugccgcugagcugcaccaagaacaacucccaccacuacaucauggugggcaacgagacgggccuggagcucacccugaccaacaccagcaucaucaaccacaaguucugcaaccuguccgacgcccacaagaagaaccucuacgaccacgcccugaugagcaucaucuccacguuccaccugagcauccccaacuucaaccaguacgaggccauguccugcgacuucaacgggggcaagaucagcgugcaguacaaccucucccacaccuacgcgggggacgccgccgaccacugcggcaccaucgccaacgggguccugcagaccuucaugcggauggcguggggcggcagcuacaucgcccuggacuccgggaagggcagcugggacugcaucaugacguccuaccaguaccucaucauccagaacaccaccugggaggaccacugccaguucagccgccccucccccaugggguaccugggccugcucagccagcggacccgcgacaucuacaucagccggcgccugcugggcacguucaccuggacccucuccgacagcgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgugaacgcccugaucaacgaccagcucaucaugaagaaccaccuccgggacaucauggggauccccuacugcaacuacagcaaguacugguaccugaaccacaccaucacgggcaagaccucccugccccgcugcuggcuggucagcaacggcuccuaccugaacgagacccacuucagcgacgacaucgagcagcaggccgacaacaugaucaccgagcuccugcagaaggaguacaucgaccggcaggggaagacgccccugggccucguggaccuguucguguucuccaccagcuucuaccugaucuccaucuuccugcaccucgucaagaucccgacccaccgccacaucaccgggaagcccugccccaagccccaccggcugaaccacaugggcaucugcagcugcgggcuguacaagcacccgggcgugcccgugcgcuggaagcgguga

SEQ ID NO: 893 - RNA, 1473 nt, Artificial Sequence
  derived and/or modified CDS sequence (opt1) from Lassa virus__AIT17666__GPC
augggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgucaacgcccugaucaacgaccagcucaucaugaagaaccaccuccgggacaucaugggcauccccuacugcaacuacuccaaguacugguaccugaaccacacggugaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucgucgaccuguucguguucagcaccuccuucuaccugaucagcaucuuccugcaccucgugaagaucccgacccaccgccacaucacgggcaagcccugccccaagccccaccggcugaaccacauggggaucugcuccugcggccuguacaagcacccggggguccccgugaaguggaagcgcuga

SEQ ID NO: 894 - RNA, 1473 nt, Artificial Sequence
  derived and/or modified CDS sequence (opt1) from Lassa virus__AIT17670__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaaggccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggcgcaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcgguga

SEQ ID NO: 895 - RNA, 1473 nt, Artificial Sequence
  derived and/or modified CDS sequence (opt1) from Lassa virus__AIT17674__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacaugaccaaccucaacaugacgaugccgcugagcugcaccaagaacaacucccaccacuacaucauggucggcaacgagaccggccuggagcucacccugacgaacaccagcaucaucaaccacaaguucugcaaccuguccgacgcccacaagaagaaccucuacaaccacgcccugaugagcaucaucuccaccuuccaccugagcauccccaacuucaaccaguacgaggccauguccugcgacuucaacgggggcaagaucagcgugcaguacaaccucucccacagcuacgccguggacgcggccaaccacugcgggaccaucgccaacggcguccugcagacguucaugcggauggccuggggcggguccuacaucgcgcuggacagcggcaaggggaacugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggccauccggcgccucaagaccgaggcgcaggccaacauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucgugaagaucccgacccaccgccacgugaucggcaagcccugccccaagccccaccggcugaaccacauggggaucugcuccugcggccuguacaagcacccggggguccccgugaaguggaagcgcuga

SEQ ID NO: 896 - RNA, 1473 nt, Artificial Sequence
  derived and/or modified CDS sequence (opt1) from Lassa virus__AIT17678__GPC
augggccagaucaucaccuucuuccaggaggugccccacgucaucgaggaggugaugaacaucgugcugaucacccucagccugcuggccauccucaaggggaucuacaacaucgccacgugcggccuguucgggcuggucuccuuccuccugcugugcggccgcagcugcuccaccaccuacaaggggguguacgagcuccagacccuggagcuggacaugacgagccucaacaugaccaugccgcuguccugcaccaagaacaacagccaccacuacaucauggugggcaacgagaccggccuggagcucacgcugaccaacaccuccaucaucaaccacaaguucugcaaccugagcgacgcgcacaagaagaaccucuacgaccacgcccugauguccaucaucagcaccuuccaccuguccauccccaacuucaaccaguacgaggccaugagcugcgacuucaacgggggcaagaucuccguccaguacaaccucagccacacguacgccguggacgccgcgaaccacugcgggaccaucgccaacggcgugcugcagaccuucaugcggauggccuggggcggguccuacaucgcccuggacagcggcaagggguccugggacugcaucaugaccagcuaccaguaccucaucauccagaacacgaccugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggcggagcucaagugcuucgggaacacggccgucgccaagugcaacgagaagcacgacgaggaguucugcgacaugcugcgccuguucgacuucaacaagcaggccauccggcgccucaagaccgaggcccagaugagcauccagcugaucaacaaggcggugaacgcccugaucaacgaccagcucaucaugaagaaccaccuccgggacaucaugggcauccccuacugcaacuacuccaaguacugguaccugaaccacaccgugaccgggaagacgagccugccccgcugcuggcuggucuccaacggcagcuaccugaacgagacccacuucuccgacgacaucgagcagcaggccgacaacaugaucaccgagcuccugcagaaggaguacaucgaccggcagggcaagaccccgcuggggcucguggaccuguucguguucagcacguccuucuaccugaucagcaucuuccugcaccucgucaagaucccgacccaccgccacaucaucggcaagcccugccccaagccccaccggcugaaccacauggggaucugcuccugcggccuguacaagcacccggggauccccgugaaguggaagcgcuga

SEQ ID NO: 897 - RNA, 1473 nt, Artificial Sequence
  derived and/or modified CDS sequence (opt1) from Lassa virus__AIT17686__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaccaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagccgcaagggcuccugggacugcaucaugaccagcuaccaguaccucaucauccagaacaccaccugggaggaccacugccaguucucccggcccagccccaucggguaccugggccugcucagccagcgcacgcgggacaucuacaucucccgccggcugcuggggaccuucaccuggacccucagcgacuccgagggcaacgagacgccgggcggguacugccugacccgcuggaugcugaucgaggccgagcucaagugcuucggcaacaccgccguggccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucauggggauccccuacugcaacuacuccaaguacugguaccugaaccacacggucaccggcaagaccagccugccccggugcuggcugguguccaacgggagcuaccugaacgagacccacuucuccgacgacaucgagcagcaggccgacaacaugaucacggagcuccugcagaaggaguacauggaccgccagggcaagacgccccugggccucguggaccuguucgucuucagcaccuccuucuaccugaucagcaucuuccugcaccucaucaagaucccgacccaccggcacgugaucgggaagcccugccccaagccccaccgccugaaccacaugggcaucugcuccugcgggcuguacaagcacccgggcgugcccgucaaguggaagcgguga

SEQ ID NO: 898 - RNA, 1473 nt, Artificial Sequence
  derived and/or modified CDS sequence (opt1) from Lassa virus__AIT17690__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccguggacgccgccucccacugcgggaccgucgcgaacggcgugcugcagaccuucaugcggauggccuggggcgggagcuacaucgcccuggacuccggcaaggggagcugggacugcaucaugacguccuaccaguaccucaucauccagaacaccaccugggaggaccacugccaguucagccgccccagccccaucggcuaccuggggcugcucucccagcggacccgcgacaucuacaucagccggcgccugcugggcacguucaccuggacccucuccgacagcgagggcaacgagacccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgucaacgcccugaucaacgaccagcucaucaugaagaaccaccuccgggacaucaugggcaucccguacugcaacuacagcaaguacugguaccugaaccacaccgugacggggcgcaccucccugccccggugcuggcuggugagcaacggcuccuaccugaacgagacccacuucagcgacgacaucgagcagcaggcggacaacaugaucaccgagcuccugcagaaggaguacauggaccgccagggcaagacgccccuggggcucgucgaccuguucguguucuccaccagcuucuaccugaucuccaucuuccugcaccucgugaagaucccgacccaccggcacgucaucggcaagcccugccccaagccccaccgccugaaccacauggggaucugcagcugcggccuguacaagcacccgggggugcccgugaaguggaagcgguga

SEQ ID NO: 899 - RNA, 1473 nt, Artificial Sequence
  derived and/or modified CDS sequence (opt1) from Lassa virus__AIT17694__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaucuacaaggggguguacgagcuccagacccuggagcuggacauggccagccucaacaugaccaugccgcuguccugcaccaagaacaacagccaccacuacaucauggucggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgucacggggaagaccagccugccccgcugcuggcugguguccaacggcagcuaccugaacgagacccacuucuccgacgacaucgagcagcaggccgacaacaugaucaccgagcuccugcagaaggaguacaucgaccggcagggcaagacgccccuggggcucguggaccuguucgucuucagcaccuccuucuaccugaucagcaucuuccugcaccucgugaagaucccgacccaccgccacguggucggcaagcccugccccaagccccaccggcugaaccacauggggaucugcuccugcggccuguacaagcacccgggggugcccgugaaguggaagcgcuga

SEQ ID NO: 900 - RNA, 1473 nt, Artificial Sequence
  derived and/or modified CDS sequence (opt1) from Lassa virus__AIT17712__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggggccugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggcgaagugcaacgagaagcacgacgaggaguucugcgacaugcugcgccuguucgacuucaacaagcaggccaucaugcggcucaagaccgaggcccagauguccauccagcugaucaacaaggccgugaacgcccugaucaacgaccagcucaucaugaagaaccaccuccgcgacaucaugggcauccccuacugcaacuacagcaaguacugguaccugaaccacacggucaccgggaagaccucccugccccggugcuggcuggugagcaacggcuccuaccugaacgagacccacuucagcgacgacaucgagcagcaggcggacaacaugaucacggagaugcuccagaaggaguacaucgaccgccagggcaagaccccgcuggggcugguggaccucuucgucuucuccaccagcuucuaccugaucuccaucuuccugcaccuggugaagaucccgacccaccggcacgugaucggcaagcccugccccaagccccaccgccucaaccacauggggaucugcagcugcggccuguacaagcacccggggguccccgugcgguggaagcgcuga

SEQ ID NO: 901 - RNA, 1473 nt, Artificial Sequence
  derived and/or modified CDS sequence (opt1) from Lassa virus__AIT17718__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacauccgggucggcaacgagaccggccuggagcucacccugaccaacgccuccaucaucaaccacaaguucugcaaccugagcgacgcccacaagaagaaccucuacgaccacgcccugauguccaucaucagcacguuccaccuguccauccccaacuucaaccaguacgaggcgaugagcugcgacuucaacgggggcaagaucuccgugcaguacaaccucagccacgccuacgccaucgacgccgcgaaccacugcgggaccguggccaacggcguccugcagaccuucaugcgcauggccuggggcggguccuacaucgcccuggacagcggccgggggaacugggacugcaucaugaccuccuaccaguaccucaucauccagaacacgaccugggaggaccacugccaguucagccgccccucccccaucggcuaccuggggcugcucagccagcggacccgcgacaucuacaucagccggcgccugcugggcaccuucacguggacccucuccgacagcgagggcaacgagacccccgggggcuacugccugacccgguggaugcugaucgaggccgagcucaagugcuucgggaacacggcgguggccaagugcaacgagaagcacgacgaggaguucugcgacaugcugcgccuguucgacuucaacaagcaggccauccggcgccucaagaccgaggcccagauguccauccagcugaucaacaaggccgugaacgcgcugaucaacgaccagcucaucaugaagaaccaccuccgggacaucaugggcauccccuacugcaacuacagcaaguacugguaccugaaccacaccgucaccgggaagacgucccugccccgcugcuggcuggugagcaacggcuccuaccugaacgagacccacuucagcgacgacaucgagcagcaggccgacaacaugaucaccgagcuccugcagaaggaguacauggaccggcagggcaagaccccgcuggggcucguggaccuguucgucuucuccacgagcuucuaccugaucuccaucuuccugcaccucgugaagaucccgacccaccgccacgugaucggcaagcccugccccaagccccaccggcugaaccacauggggaucugcagcugcggcuucuacaagcacccggggguccccgugaaguggaagcgcuga

SEQ ID NO: 902 - RNA, 1473 nt, Artificial Sequence
  derived and/or modified CDS sequence (opt1) from Lassa virus__AIT17724__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgguggacgccgccaaccacugcgggaccgucgccaacggcgugcugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccucccccaucggcuaccuggggcugcucagccagcggacgcgcgacaucuacaucagccggcgccugcugggcaccuucaccuggacccucuccgacagcgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagauguccauccagcugaucaacaaggccgucaacgcccugaucaacgaccagcucaucaugaagaaccaccuccgggacaucaugggcauccccuacugcaacuacagcaaguacugguaccugaaccacacggugaccgggaagaccucccugccccgcugcuggcuggugagcaacggcuccuaccugaacgagacccacuucagcgacgacaucgagcagcaggccgacaacaugaucacggagcuccugcagaaggaguacauggaccggcagggcaagaccccgcuggggcucgucgaccuguucguguucuccaccagcuucuaccugaucuccaucuuccugcaccucgugaagaucccgacccaccgccacaucaugggcaagcccugccccaagccccaccggcugaaccacauggggaucugcagcugcggccuguacaagcacccggggguccccgugaaguggaagcgcuga

SEQ ID NO: 903 - RNA, 1473 nt, Artificial Sequence
  derived and/or modified CDS sequence (opt1) from Lassa virus__AIT17728__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaccaccuacaaggggguguacgagcuccagacccuggagcuggacaugggcagccucaacaugaccaugccgcuguccugcacgaagaacaacagccaccacuacaucauggucggcaacgagaccgggcuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacggcgggaagaucuccgugcaguacaaccucagccacaccuacgccguggacgcggccaaccacugcggcaccaucgccaacgggguccugcagacguucaugcggauggccuggggcggcuccuacaucgcgcuggacagcgggaagggcuccugggacugcaucaugaccagcuaccaguaccucaucauccagaacaccaccugggaggaccacugccaguucucccgccccagccccaucggguaccugggccugcucagccagcggacgcgcgacaucuacaucucccggcgccugcugggcaccuucaccuggacccucagcgacuccgaggggaacgagacgccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccggcgccucaagaccgaggcgcagaugagcauccagcugaucaacaaggccgugaacgcccugaucaacgaccagcucaucaugaagaaccaccuccgggacaucauggggauccccuacugcaacuacuccaaguacugguaccugaaccacacggucaccggcaagaccagccugccccgcugcuggcugguguccaacggcagcuaccugaacgagacccacuucuccgacgacaucgagcagcaggccgacaacaugaucacggagcuccugcagaaggaguacauggaccggcaggggaagacgccccugggccucguggaccuguucgucuucagcaccuccuucuaccugaucagcaucuuccugcaccucgugaagaucccgacccaccgccacgugaucgggaagcccugccccaagccccaccggcugaaccacaugggcaucugcuccugcgggcuguacaagcacccgggcguccccgugaaguggaagcgcuga

SEQ ID NO: 904 - RNA, 1473 nt, Artificial Sequence
  derived and/or modified CDS sequence (opt1) from Lassa virus__AIT17732__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacaucgaccggcagggcaagaccccgcuggggcucguggaccuguucgucuucagcaccuccuucuaccugaucagcaucuuccugcaccucgugaagaucccgacccaccgccacaucgugggcaagcccugccccaagccccaccggcugaaccacauggggaucugcuccugcggccuguacaagcacccggggguccccgugaaguggaagcgcuga

SEQ ID NO: 905 - RNA, 1473 nt, Artificial Sequence
  derived and/or modified CDS sequence (opt1) from Lassa virus__AIT17736__GPC
augggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccagacccuggagcuggacauggccagccucaacaugaccaugccgcuguccugcacgaagaacaacagccaccacuacaucauggugggcaacgagaccggccuggagcucacccugaccaacacguccaucaucaaccacaaguucugcaaccugagcgacgcccacaagaaggaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcggucgacgccgccaaccacugcgggaccaucgccaacggcgugcugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaugcggcucaagaccgaggcccagaugagcauccagcugaucaacaaggccgucaacgcccugaucaacgaccagcucaucaugaagaaccaccuccgcgacaucaugggcauccccuacugcaacuacuccaaguacugguaccugaaccacacggugaccgggaagaccagccugccccggugcuggcugguguccaacggcagcuaccugaacgagacccgcuucuccgacgacaucgagcagcaggccgacaacaugaucacggagaugcuccagaaggaguaccuggaccggcagggcaagaccccgcuggggcucgucgaccuguucguguucagcaccuccuucuaccugaucagcaucuuccugcaccucgugaagaucccgacccaccgccacaucaucggcaagcccugccccaagccccaccggcugaaccacauggggaucugcuccugcggccuguacaagcacccggggguccccgugaaguggaagcgcuga

SEQ ID NO: 906 - RNA, 1473 nt, Artificial Sequence
  derived and/or modified CDS sequence (opt1) from Lassa virus__AIT17744__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugauguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggugggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcguccaguacaaccucucccacgcguacgccguggacgccgccaaccacugcgggaccaucgcgaacggcgugcugcagaccuucaugcggauggccuggggcgggagcuacaucgcccuggacuccggcaaggggagcugggacugcaucaugacguccuaccaguaccucaucauccagaacaccagcugggaggaccacugccaguucucccgccccagccccaucggcuaccuggggcugcucagccagcggacccgcgacaucuacaucucccggcgccugcugggcaccuucacguggacccucagcgacuccgagggcaacgagacccccgggggcuacugccugacccgguggaugcugaucgaggccgagcucaagugcuucgggaacacggccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacaccgugaccgggaagacgagccugccccgcugcuggcuggucuccaacggcagcuaccugaacgagacccacuucuccgacgacaucgagcagcaggcggacaacaugaucaccgagcuccugcagaaggaguacaucgaccggcagggcaagaccccgcuggggcucguggaccuguucguguucagcacguccuucuaccugaucagcaucuuccugcaccucgucaagaucccgacccaccgccacgugaucggcaagcccugccccaagccccaccggcugaaccacauggggaucugcuccugcggccuguacaagcacccgggggugcccgucaaguggaagcgcuga

SEQ ID NO: 907 - RNA, 1473 nt, Artificial Sequence
  derived and/or modified CDS sequence (opt1) from Lassa virus__AIT17752__GPC
augggccagaucaucaccuucuuccacgaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgaucgacgccgccaaccacugcgggaccaucgccaacggcgugcugcagacguucaugcggauggcguggggcggguccuacaucgcccuggacagcggccgcggguccugggacugcaucaugaccagcuaccaguaccucaucauccagaacaccaccugggaggaccacugccaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccgucgccaagugcaacgagaagcacgacgaggaguucugcgacaugcugcggcuguucgacuucaacaagcaggcgauccgccggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggugaccgggaagaccagccugccccggugcuggcuggucuccaacggcagcuaccugaacgagacccacuucuccgacgacaucgagcagcaggccgacaacaugaucacggagcuccugcagaaggaguacaucgaccgccagggcaagaccccgcuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcgguga

SEQ ID NO: 908 - RNA, 1473 nt, Artificial Sequence
  derived and/or modified CDS sequence (opt1) from Lassa virus__AIT17756__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccaucacguacaaggggguguacgagcuccagacccuggagcuggacauggccagccucaacaugaccaugccgcuguccugcaccaagaacaacagccaccacuacaucauggucggcaacgagacgggccuggagcucacccugaccaacaccuccaucaucaaccacaaguucugcaaccugagcgacgcccacaagaagaaccucuacgaccacgcccugauguccaucaucagcacguuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagaccuucaugcggauggcguggggcggguccuacaucgcccuggacagcggccgcggguccugggacugcaucaugacgagcuaccaguaccucaucauccagaacaccaccugggaggaccacugccaguucucccggcccagccccaucggcuaccuggggcugcucagccagcgcacccgggacaucuacaucucccgccggcugcugggcacguucaccuggacccucagcgacuccgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacaccgucaccgggcggacgagccugccccgcugcuggcugguguccaacggcagcuaccugaacgagacccacuucuccgacgacaucgagcagcaggcggacaacaugaucaccgagcuccugcagaaggaguacaucgaccggcagggcaagaccccgcuggggcucguggaccuguucgucuucagcacguccuucuaccugaucagcaucuuccugcaccucgugaagaucccgacccaccgccacaucaucggcaagcccugccccaagccccaccggcugaaccacauggggaucugcuccugcggccuguacaagcacccgggggugcccgucaaguggaagcgcuga

SEQ ID NO: 909 - RNA, 1473 nt, Artificial Sequence
  derived and/or modified CDS sequence (opt1) from Lassa virus__AIT17758__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcugaacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagcggaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaagcacugcgggaccaucgccaacggcguccugcagacguucaugcgcauggcguggggcggguccuacaucgcccuggacagcggcaagggguccugggacugcaucaugaccagcuaccaguaccucaucauccagaacaccaccugggaggaccacugcgaguucucccggcccagccccaucggcuaccuggggcugcucagccagcgcacgcgggacaucuacaucucccgccggcugcugggcaccuucaccuggacccucagcgacuccgagggcaacgagacgcccgggggcuacugccugacccgcuggaugcugaucgaggccgagcucaagugcuucgggaacaccgccguggccaagugcaacgagaagcacgacgaggaguucugcgacaugcugcggcuguucgacuucaacaagcaggcgauccgccggcucaaggccgaggcccagaugagcauccagcugaucaacaaggccgugaacgcccugaucaacgaccagcucaucaugaagaaccaccuccgcgacaucaugggcaucccguacugcaacuacuccaaguacugguaccugaaccacaccgucacggggaagaccagccugccccggugcuggcugguguccaacggcagcuaccugaacgagacccacuucuccgacgacaucgagcagcaggcggacaacaugaucaccgagcuccugcagaaggaguacaucgaccgccagggcaagacgccccuggggcucguggaccuguucgucuucagcaccuccuucuaccugaucagcaucuuccugcaccucgugaagaucccgacccaccggcacgugaucggcaagcccugccccaagccccaccgccugaaccacauggggaucugcuccugcggccuguacaagcacccggggguccccgugaaguggaagcgguga

SEQ ID NO: 910 - RNA, 1473 nt, Artificial Sequence
  derived and/or modified CDS sequence (opt1) from Lassa virus__AIT17762__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucagccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgguggacgccgccaaccacugcgggaccaucgccaacggcguccugcagacguucaugcggauggcguggggcgggagcuacaucgcccuggacuccggcaaggggagcugggacugcaucaugaccuccuaccaguaccucaucauccagaacaccaccugggaggaccacugccaguucagccgccccagccccaucggcuaccuggggcugcucucccagcggacgcgcgacaucuacaucagccggcgccugcugggcaccuucaccuggacccucuccgacagcgagggcaacgaggcccccgggggcuacugccugacgcgguggaugcugaucgaggccgagcucaagugcuucgggaacaccgccguggcgaagugcaacgagaagcacgacgaggaguucugcgacaugcugcgccuguucgacuucaacaagcaggccauccggcgccucaagaccgaggcccagauguccauccagcugaucaacaaggccgugaacgcccugaucaacgaccagcucaucaugaagaaccaccuccgggacaucaugggcaucccguacugcaacuacagccgcuacugguaccugaaccacaccgucacggggaagaccucccugccccggugcuggcuggugagcaacggcuccuaccugaacgagacccacuucagcgacgacaucgagcagcaggcggacaacaugaucaccgagcuccugcagaaggaguacauggaccgccagggcaagacgccccuggggcucguggaccuguucgucuucuccaccagcuucuaccugaucuccaucuuccugcaccucgugaagaucccgacccaccggcacgugaucggcaagcccugccccaagccccaccgccugaaccacauggggaucugcagcugcggccuguacaagcacccggggguccccgugaaguggaagcgguga

SEQ ID NO: 911 - RNA, 1473 nt, Artificial Sequence
  derived and/or modified CDS sequence (opt1) from Lassa virus__AIT17770__GPC
augggccagaucgugaccuucuuccaggaggucccccacgugaucgaggaggugaugaacaucguccugaucgcccucagccugcuggccauccucaaggggaucuacaacguggcgaccugcggccuguucgggcugguguccuuccuccugcugugcggccgcagcugcuccacgaccuacaagggggucuacgagcuccaggcccuggagcuggacaugagcucccucaacaugaccaugccgcugagcugcaccaagaacaacucccaccacuacaucauggugggcaacgagacgggccuggagcucacccugaccaacaccagcaucauccaccacaaguucugcaaccuguccgacgcccacaagaaggaccucuacgaccacgcccugaugagcaucaucuccacguuccaccugagcauccccaacuucaaccaguacgaggccauguccugcgacuucaacgggggcaagaucagcgugcaguacaaccucucccacaccuacgcggucgacgccgccaaccacugcgggaccaucgccaacggcgugcugcagaccuucaugcggauggcguggggcgggagcuacaucgcccuggacuccggcaagggcgggugggacugcaucaugacgagcuaccaguuccucaucauccagaacaccaccugggaggaccacugccaguucucccgccccagccccaucggguaccugggccugcucagccagcggacccgcgacaucuacaucucccggcgccugcugggcacguucaccuggacccucagcgacuccgaggggaacgagaccccgggcggguacugccugacgcgguggaugcugaucgaggccgagcucaagugcuucggcaacaccgccguggccaagugcaacgagaagcacgacgaggaguucugcgacaugcugcgccuguucgacuucaacaagcaggcgaucaagcggcucaagaccgaggcccagaugagcauccaccugaucaacaaggccgucaacgcccugaucaacgaccagcucaucaugaagaaccaccuccgcgacaucauggggauccccuacugcaacuacuccaaguacugguaccugaaccacaccgugacgggcaagaccagccugccccggugcuggcugguguccaacggcagcuaccugaacgagacccacuucuccgacgacaucgagcagcaggccgacaacaugaucaccgagcuccugcagaaggaguacaucgaccgccaggggaagacgccccugggccucgucgaccuguucguguucagcaccuccuucuaccugaucagcaucuuccugcaccucgugaagaucccgacccaccggcacgucaucgggaagcccugccccaagccccaccgccugaaccacaugggcaucugcuccugcgggcuguacaagcacccgggcgugcccgugcgguggaagcgcuga

SEQ ID NO: 912 - RNA, 1473 nt, Artificial Sequence
  derived and/or modified CDS sequence (opt1) from Lassa virus__AIT17778__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccaaccucaacaugaccaugccgcugagcugcacgaagaacaacucccaccacuacaucauggucggcaacgagaccggccuggagcucacccugaccaacacgagcaucaucaaccacaaguucugcaaccuguccgacgcccacaagaagaaccucuacgaccacgcccugaugagcaucaucuccaccuuccaccugagcauccccaacuucaaccaguacgaggccauguccugcgacuucaacgggggcaagaucagcgugcaguacaaccucucccacaccuacgcgcgggacgccgccaaccacugcgggaccaucgccaacggcgugcugcagacguucaugcgcauggcguggggcgggagcuacaucgcccuggacuccggcaaggggagcugggacugcaucaugaccuccuaccaguaccucaucauccagaacaccaccugggaggaccacugccaguucagccggcccucccccaucggcuaccuggggcugcucagccagcgcacgcgggacaucuacaucagccgccggcugcugggcaccuucaccuggacccucuccgacagcgagggcaacgagacgcccgggggcuacugccugacccgcuggaugcugaucgaggccgagcucaagugcuucgggaacaccgccgucgccaagugcaacgagaagcacgacgaggaguucugcgacaugcugcggcuguucgacuucaacaagcaggcgauccgccggcucaagaccgaggcccagaugaacauccagcugaucaacaaggccgugaacgcccugaucaacgaccagcucaucaugaagaaccaccuccgcgacaucaugggcauccccuacugcaacuacuccaaguacugguaccugaaccacacggugaccgggaagaccagccugccccggugcuggcuggucuccaacggcagcuaccugaacgagacccacuucuccgacgacaucgagcagcaggccgacaacaugaucacggagcuccugcagaaggaguacauggaccgccagggcaagaccccgcuggggcucguggaccuguucguguucagcaccuccuucuaccugaucagcaucuuccugcaccucgucaagaucccgacccaccggcacgugaucggcaagcccugccccaagccccaccgccugaaccacauggggaucugcuccugcggccuguacaagcacccgggggugcccgucaaguggaagcgguga

SEQ ID NO: 913 - RNA, 1473 nt, Artificial Sequence
  derived and/or modified CDS sequence (opt1) from Lassa virus__AIT17782__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaagcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagcuccugcagaaggaguacaucgaccgccagggcaagaccccgcuggggcucguggaccuguucgucuucagcaccuccuucuaccugaucagcaucuuccugcaccucgugaagaucccgacccaccggcacguggucggcaagcccugccccaagccccaccgccugaaccacauggggaucugcuccugcggccuguacaagcacccgggggugcccgugaaguggaagcgguga

SEQ ID NO: 914 - RNA, 1473 nt, Artificial Sequence
  derived and/or modified CDS sequence (opt1) from Lassa virus__AIT17786__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacgcguacgccaucgacgccgccgaccacugcgggaccaucgcgaacggcgugcugcagaccuucaugcggauggccuggggcggguccuacaucgcccuggacagcggcaagggguccugggacugcaucaugacgagcuaccaguaccucaucauccagaacaccaccugggaggaccacugccaguucucccgccccagccccaucggcuaccuggggcugcucagccagcggacccgcgacaucuacaucucccggcgccugcugggcacguucaccuggacccucagcgacuccgagggcaacgagacccccgggggcuacugccugacgcgguggaugcugaucgaggccgagcucaagugcuucgggaacaccgccgucgcgaagugcaacgagaagcacgacgaggaguucugcgacaugcugcgccuguucgacuucaacaagcaggccauccggcgccucaagaccgaggcccagaugagcauccagcugaucaacaaggccgugaacgcccugaucaacgaccagcucaucaugaagaaccaccuccgggacaucaugggcaucccguacugcaacuacuccaaguacugguaccugaaccacaccgugacggggaagaccagccugccccgcugcuggcuggucuccaacggcagcuaccugaacgagacccacuucuccgacgacaucgagcagcaggcggacaacaugaucaccgagcuccugcagaaggaguacauggaccggcagggcaagacgccccuggggcucguggaccuguucguguucagcaccuccuucuaccugaucagcaucuuccugcaccucgucaagaucccgacccaccgccacaucaccggcaagcccugccccaagccccaccggcugaaccacauggggaucugcuccugcggccuguacaagcacccgggggugcccgugaaguggaagcgcuga

SEQ ID NO: 915 - RNA, 1473 nt, Artificial Sequence
  derived and/or modified CDS sequence (opt1) from Lassa virus__AIT17790__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgauccggcgccucaagaccgaggcccagaugagcauccagcugaucaacaaggccgugaacgcccugaucaacgaccagcucaucaugaagaaccaccuccgggacaucaugggcauccccuacugcaacuacuccaaguacugguaccugaaccacacggucaccgggaagaccagccugccccgcugcuggcugguguccaacggcagcuaccugaacgagacccacuucuccgacgacaucgagcagcaggccgacaacaugaucacggagcuccugcagaaggaguacauggaccggcagggcaagaccccgcuggggcucguggaccuguucgucuucagcaccuccuucuaccugaucagcaucuuccugcaccucgugaagaucccgacccaccgccacaucacgggcaagcccugccccaagccccaccggcugaaccacauggggaucugcuccugcggccuguacaagcacccgggggugcccgucaaguggaagcgcuga

SEQ ID NO: 916 - RNA, 1473 nt, Artificial Sequence
  derived and/or modified CDS sequence (opt1) from Lassa virus__AIT17798__GPC
augggccagaucaucaccuucuuccaggaggugccccacgucaucgaggaggugaugaacaucgugcugaucgcccucagccugcuggccauccucaaggggaucuacaacgucgcgaccugcggccuguucgggcugguguccuuccuccugcugugcggccgcagcugcuccacgaccuacaaggggguguacgagcuccagacccuggagcuggacauggccagccucaacaugaccaugccgcuguccugcacgaagaacaacagccaccacuacaucauggucggcaacgagaccggccuggagcucacccugaccaacacguccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacaccuacgcgguggacgccgccaaccacugcgggaccaucgccaacggcguccugcagacguucaugcggauggcguggggcggguccuacaucgcccuggacagcggcaagggguccugggacugcaucaugaccagcuaccaguaccucaucauccagaacaccaccugggaggaccacugccaguucucccgccccagccccaucggcuaccuggggcugcucagccagcggacgcgcgacaucuacaucucccggcgccugcugggcaccuucaccuggacccucagcgacuccgagggcaacgagacgcccgggggcuacugccugacccgguggaugcugaucgaggccgagcucaagugcuucgggaacaccgccguggccaagugcaacgagaagcacgacgaggaguucugcgacaugcugcgccuguucgacuucaacaagcaggcgaucaugcggcucaagaccgaggcccagaugagcauccagcugaucaacaaggccgugaacgcccugaucaacgaccagcucaucaugaagaaccaccuccgcgacaucaugggcauccccuacugcaacuacuccaaguacugguaccugaaccacacggucaccgggaagaccagccugccccggugcuggcugguguccaacggcagcuaccugaacgagacccacuucuccgacgacaucgagcagcaggccgacaacaugaucacggagaugcuccagaaggaguaccuggaccgccagggcaagaccccgcuggggcucguggaccuguucgucuucagcaccuccuucuaccugaucagcaucuuccugcaccucgugaagaucccgacccaccggcacaucaucggcaagcccugccccaagccccaccgccugaaccacauggggaucugcuccugcggccuguacaagcacccgggggugcccgucaaguggaagcgguga

SEQ ID NO: 917 - RNA, 1476 nt, Artificial Sequence
  derived and/or modified CDS sequence (opt1) from Lassa virus__AIT17802__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaagaacaacagccaccacuacaucauggugggcaacgagaccggccuggagcugacgcucaccaacaccuccaucaucaaccacaaguucugcaaccugagcgacgcccacaagaagaaccuguacaaccacgcccucauguccaucaucagcaccuuccaccuguccauccccaacuucaaccaguacgaggccaugagcugcgacuucaacgggggcaagaucuccguccaguacaaccugagccacuccuacgccggggacgcggccaaccacugcggcacgguggccaacggggugcuccagaccuucaugcggauggccuggggcggcagcuacaucgcgcuggacuccgggcgcgaccggugggacugcaucaugaccagcuaccaguaccugaucauccagaacaccacgugggaggaccacugccaguucucccgccccagccccaucggcuaccucgggcugcugucccagcggacccgcgacaucuacaucagccggcgccuccugggcaccuucaccuggacgcugagcgacuccgagggcaaggacacccccgggggcuacugccucacccgguggaugcugaucgaggccgagcugaagugcuucgggaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucaugggcauccccuacugcaacuacuccaaguacugguaccugaaccacacgaccaccgggaagaccagccugcccaagugcuggcucguguccaacggcagcuaccugaacgagacgcacuucuccgacgacaucgagcagcaggccgacaacaugaucaccgagaugcugcagaaggaguacauggagcggcucggcaagaccccgcuggggcuggucgaccuguucguguucagcaccuccuucuaccucaucagcaucuuccugcaccuggugaagaucccgacgcaccgccacaucgucggccgguccugccccaagccccaccgccucaaccacauggggaucugcagcugcggccuguacaagcagcccggggugccggugaaguggaagcgguga

SEQ ID NO: 918 - RNA, 1476 nt, Artificial Sequence
  derived and/or modified CDS sequence (opt1) from Lassa virus__AIT17806__GPC
augggccagaucgugaccuucuuccaggaggucccccacgugaucgaggaggugaugaacaucguccugaucgcccucagcauccuggccgugcugaaggggcucuacaacuucgcgaccugcggccugaucgggcuggugacguuccuccugcugugcggccgcuccugcaccaccagccucuacaagggggucuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggcaagugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcgguga

SEQ ID NO: 919 - RNA, 1476 nt, Artificial Sequence
  derived and/or modified CDS sequence (opt1) from Lassa virus__AIT17810__GPC
augggccagaucgugaccuucuuccaggaggucccccacgugaucgaggaggugaugaacaucguccugaucgcccucagcauccuggccgugcugaaggggcucuacaaccuggcgaccugcggccugguggggcucgucacguuccugcugcucugcggccgcuccugcaccaccagccuguacaaggggguguacgagcugcagacccucgagcugaacauggagacgcugaacaugaccaugccgcucuccugcaccaaggacaacagccaccacuacauccgggugggcaacgagaccggccuggagcugacgcucaccaacaccuccauccugaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggccgcaucuccguccaguacaaccucagccacuccuacgccggggacgcggccaaccacugcggcacgguggccaacggggugcugcagaccuucaugcggauggccuggggcggcagcuacaucgcgcuggacuccgggcgcggccggugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccgucgccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugccccggugcuggcugguguccaacggcagcuaccugaacgagacgcacuucuccgacgacaucgagcagcaggccgacaacaugaucaccgagaugcuccagaaggaguacauggagcgccaggggaagacgccccugggccuggucgaccuguucguguucagcaccuccuucuaccucaucagcaucuuccugcaccuggugaagaucccgacccaccggcacgucguggggaagcccugccccaagccccaccgccucaaccacaugggcaucugcuccugcgggcuguacaagcagccgggcgugcccgucaaguggaagcgguga

SEQ ID NO: 920 - RNA, 1476 nt, Artificial Sequence
  derived and/or modified CDS sequence (opt1) from Lassa virus__AIT17814__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucgaccacaaguucugcaaccucagcgacgcccaccggaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccaaggacgcggccgaccacugcgggacgguggccaacggcgugcugcagaccuucaugcgcauggccuggggcgggagcuacaucgcgcucgacuccggccgggggcgcugggacugcaucaugaccagcuaccaguaccugaucauccagaacaccacgugggaggaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcgccagggcaagaccccgcuggggcucgucgaccuguucguguucagcaccuccuucuaccugaucagcaucuuccugcaccucgugaagaucccgacgcaccggcacaucgucggcaagcccugccccaagccccaccgccugaaccacauggggaucugcuccugcggccuguacaagcagccgggggugcccgugaaguggaagcgguga

SEQ ID NO: 921 - RNA, 1476 nt, Artificial Sequence
  derived and/or modified CDS sequence (opt1) from Lassa virus__AIT17820__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaaggggguguacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccgaggacgcggccaaccacugcgggacgguggccaacggcgugcugcagaccuucaugcggauggccuggggcgggagcuacaucgcgcucgacuccggccgcgggaacugggacugcaucaugaccagcuaccaguaccugaucauccagaacaccacgugggaggaccacugccaguucucccggcccagccccaucggcuaccuggggcuccugucccagcgcacccgggacaucuacaucagccgccggcugcucggcaccuucaccuggacgcugagcgacuccgagggcaaggacacccccgggggcuacugccugacccgcuggaugcucaucgaggccgagcugaagugcuucgggaacaccgccgucgccaagugcaacgagaagcacgacgaggaguucugcgacaugcugcggcuguucgacuucaacaagcaggccauccagcgccugaaggcggaggcccagaugagcauccagcugaucaacaaggccgugaacgcccucaucaacgaccagcugaucaugaagaaccaccuccgggacaucaugggcauccccuacugcaacuacuccaaguacugguaccucaaccacacgaccaccgggaagaccagccugcccaagugcuggcugguguccaacggcagcuaccucaacgagacgcacuucuccgacgacaucgagcagcaggccgacaacaugaucaccgagaugcugcagaaggaguacauggagcgccagggcaagaccccgcuggggcucgucgaccuguucguguucagcaccuccuucuaccugaucagcaucuuccugcaccucgugaagaucccgacgcaccggcacaucgucggcaaguccugccccaagccccaccgccugaaccacauggggaucugcagcugcggccuguacaagcagcccggggugccggugaaguggaagcgguga

SEQ ID NO: 922 - RNA, 1476 nt, Artificial Sequence
  derived and/or modified CDS sequence (opt1) from Lassa virus__AIT17824__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagcguguacaaggggguguacgagcuccagacccuggagcugaacauggagacgcucaacaugaccaugccgcuguccugcaccaagaacaacagccaccacuacaucauggucggcaacgagaccggccuggagcucacgcugaccaacaccuccaucaucaaccacaaguucugcaaccugagcgacgcccacaagaagaaccucuacgaccacgcccugauguccaucaucagcaccuuccaccuguccauccccaacuucaaccaguacgaggccaugagcugcgacuucaacgggggcaagaucuccgugcaguacaaccucagccacuccuacgccggggacgcggccaaccacugcggcacgguggccaacgggguccugcagaccuucaugcggauggccuggggcggcagcuacaucgcgcuggacuccgggcacggcaagugggacugcaucaugaccagcuaccaguaccucaucauccagaacaccacgugggaggaccacugccaguucucccgccccagccccaucggguaccugggccugcucucccagcggacccgcgacaucuacaucagccggcgccugcugggcaccuucaccuggacgcucagcgacuccgaggggaaggacaccccgggcggguacugccugacccgguggaugcugaucgaggccgagcucaagugcuucggcaacaccgccguggccaagugcaacgagaagcacgacgaggaguucugcgacaugcugcgccuguucgacuucaacaagcaggccauccagcggcucaaggcggaggcccagaugagcauccagcugaucaacaaggccgugaacgcccugaucaacgaccagcucaucaugaagaaccaccuccgcgacaucauggggauccccuacugcaacuacuccaaguacugguaccugaaccacacgaccaccggcaagaccagccugcccaagugcuggcuggucuccaacggcagcuaccugaacgagacgcacuucuccgacgacaucgagcagcaggccgacaacaugaucaccgagaugcuccagaaggaguacauggagcggcaggggaagacgccccugggccugguggaccucuucguguucagcaccuccuucuaccugaucagcaucuuccugcaccuggucaagaucccgacccaccgccacaucguggggaaguccugccccaagccccaccggcucaaccacaugggcaucugcagcugcgggcuguacaagcagcccggcgugccgguccgcuggaagcgguga

SEQ ID NO: 923 - RNA, 1476 nt, Artificial Sequence
  derived and/or modified CDS sequence (opt1) from Lassa virus__AIT17828__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaccagccucuacaagggggacuacgagcugcagacccuggagcucaacauggagacgcugaacaugaccaugccgcuguccugcaccaagaacaacagccaccacuacaucauggugggcaacgagaccggccucgagcugacgcugaccaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccgugcaguacaaccugagccacuccuacgccggggacgcggccaaccacugcggcacggucgccaacggggugcugcagaccuucaugcggauggccuggggcggcagcuacaucgcgcucgacuccgggcgcggcaacugggacugcaucaugaccagcuaccaguaccugaucauccagaacaccacgugggaggaccacugccaguucucccggcccagccccaucggguaccugggccuccugucccagcgcacccgggacaucuacaucagccgccggcugcucggcaccuucaccuggacgcugagcgacuccgaggggaaggacaccccgggcggguacugccugacccgcuggaugcucaucgaggccgagcugaagugcuucggcaacaccgccguggccaagugcaacgagaagcacgacgaggaguucugcgacaugcugcggcuguucgacuucaacaagcaggccauccagcgccugaaggcggaggcccagaugagcauccagcugaucaacaaggccgucaacgcccucaucaacgaccagcugaucaugaagaaccaccuccgggacaucauggggauccccuacugcaacuacuccaaguacugguaccucaaccacacgaccaccggcaagaccagccugcccaagugcuggcugguguccaacggcagcuaccucaacgagacgcacuucuccgacgacaucgagcagcaggccgacaacaugaucaccgagaugcugcagaaggaguacauggagcgccaggggaagacgccccugggccucguggaccuguucgucuucagcaccuccuucuaccugaucagcaucuuccugcaccucgugaagaucccgacccaccggcacaucguggggaaguccugccccaagccccaccgccugaaccacaugggcaucugcagcugcgggcuguacaagcagcccggcgucccggugaaguggaagcgguga

SEQ ID NO: 924 - RNA, 1473 nt, Artificial Sequence
  derived and/or modified CDS sequence (opt1) from Lassa virus__AIT17836__GPC
augggccagaucaucaccuucuuccaggaggugccccacgucaucgaggaggugaugaacaucgugcugaucgcccucagccugcuggccauccucaaggggcuguacaacaucgcgaccugcggcaucaucgggcuggucgccuuccucuuccugugcggcaaguccugcagccugacgcucaagggcggguacgagcugcagacccuggagcucaacauggagacccugaacaugaccaugccgcuguccugcacgaagaacagcucccaccacuacauccgcgugggcaacgagaccgggcucgagcugacccugaccaacacgagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaacggcgggaagaucagcgugcaguacaaccugucccacagcuacgcgggcgacgccgccgagcacugcgggaccgucgccaacggcgugcugcagaccuucaugcggauggcguggggcgggcgcuacaucgcccucgacuccggcaaggggaacugggacugcaucaugacgagcuaccaguaccugaucauccagaacaccaccugggaggaccacugccaguucucccggcccagccccaucggcuaccugggccuccugucccagcgcacccgggacaucuacaucagccgccggcugcucgggacguucaccuggacccugagcgacuccgagggcaacgagacccccgggggcuacugccugacgcgcuggaugcucaucgaggccgagcugaagugcuucgggaacaccgccguggccaagugcaacgagaagcacgacgaggaguucugcgacaugcugcggcuguucgacuucaacaagcaggcgauccgccggcugaaggccgaggcccagaugagcauccagcugaucaacaaggccgucaacgcccucaucaacgaccagcugaucaugaagaaccaccuccgcgacaucaugggcauccccuacugcaacuacuccaaguacugguaccucaaccacaccagcuccggccggaccagccugcccaagugcuggcugaucuccaacgggagcuaccucaacgagacgcaguucuccgacgacaucgagcagcaggcggacaacaugaucaccgagaugcugcagaaggaguacaucgagcgccagggcaagaccccgcuggggcucguggacaucuucaucuucagcaccuccuucuaccugaucagcaucuuccugcaccugaucaagaucccgacgcaccggcacaucgugggcaagcccugccccaagccccaccgccucaaccacaugggggucugcuccugcggccuguacaagcacccgggcgugcccaccaaguggaagcgguga

SEQ ID NO: 925 - RNA, 1476 nt, Artificial Sequence
  derived and/or modified CDS sequence (opt1) from Lassa virus__AIT17840__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaucagccucuacaaggggguguacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcgaccggugggacugcaucaugaccagcuaccaguaccugaucauccagaacaccaccugggaggaccacugccaguucucccgccccagccccaucggcuaccuggggcuccugucccagcggacgcgcgacaucuacaucagccggcgccugcucggcaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaacaaggccgugaacgcccucaucaacgaccagcugaucaugaagaaccaccuccgcgacaucaugggcauccccuacugcaacuacuccaaguacugguaccugaaccacaccacgaccgggaagaccagccugcccaagugcuggcugguguccaacggcagcuaccucaacgagacccacuucuccgacgacaucgagcagcaggccgacaacaugaucacggagaugcugcagaaggaguacauggagcggcagggcaagaccccgcuggggcucgucgaccuguucguguucagcaccuccuucuaccugaucagcaucuuccugcaccucgugaagaucccgacccaccgccacaucgucggcaagcccugccccaagccccaccggcugaaccacauggggaucugcuccugcggccuguacaagcagccgggggugcccgugaaguggaagcgcuga

SEQ ID NO: 926 - RNA, 1476 nt, Artificial Sequence
  derived and/or modified CDS sequence (opt1) from Lassa virus__AIT17844__GPC
augggccagaucgugaccuucuuccaggaggucccccacgugaucgaggaggugaugaacaucguccugaucgcccucagcauccuggccgugcugaaggggcucuacaacuucgcgaccugcggccugguggggcuggucacguuccuccugcugugcggccgcuccugcaccaucagccucuacaaggggguguacgagcugcagacccuggagcucaacauggagacccugaacaugacgaugccgcuguccugcaccaagaacaacagccaccacuacaucauggugggcaacgagaccggccucgagcugacccugacgaacaccuccaucaucaaccacaaguucugcaaccucagcgacgcccacaagaagaaccuguacgaccacgcccugauguccaucaucagcaccuuccaccucuccauccccaacuucaaccaguacgaggccaugagcugcgacuucaacgggggcaagaucuccguccaguacaaccugagccacuccuacgccggggacgcggccaaccacugcggcaccguggccaacggggugcugcagacguucaugcggauggccuggggcggcagcuacaucgcgcucgacuccgggcgcgaccggugggacugcaucaugaccagcuaccaguaccugaucauccagaacaccaccugggaggaccacugccaguucucccgccccagccccaucggcuaccuggggcuccugucccagcggacgcgcgacaucuacaucagccggcgccugcucggcaccuucaccuggacccugagcgacuccgagggcaaggacacgcccgggggcuacugccugacccgguggaugcucaucgaggccgagcugaagugcuucgggaacaccgccgucgccaagugcaacgagaagcacgacgaggaguucugcgacaugcugcgccucuucgacuucaacaagcaggccauccagcggcugaaggcggaggcccagaugagcauccagcugaucaaccgcgccgugaacgcccucaucaacgaccagcugaucaugaagaaccaccuccgggacaucaugggcauccccuacugcaacuacuccaaguacugguaccugaaccacaccacgaccgggaagaccagccugcccaagugcuggcugguguccaacggcagcuaccucaacgagacccacuucuccgacgacaucgagcagcaggccgacaacaugaucacggagaugcugcagaaggaguacauggagcgccagggcaagaccccgcuggggcucgucgaccuguucguguucagcaccuccuucuaccugaucagcaucuuccugcaccucgugaagaucccgacccaccggcacaucgucggcaagcccugccccaagccccaccgccugaaccacauggggaucugcuccugcggccuguacaagcagccgggggugcccgugaaguggaagcgguga

SEQ ID NO: 927 - RNA, 1473 nt, Artificial Sequence
  derived and/or modified CDS sequence (opt1) from Lassa virus__AMR44577__GPC
augggccagaucaucaccuucuuccaggaggugccccacgucaucgaggaggugaugaacaucgugcugaucgcccucagccugcuggccauccucaagggggucuacaacguggcgaccugcggcaucaucgggcuggugacguuccuguuccucugcggccgcuccugcagccugaucuacaagggguccuacgagcugcagacccucgagcugaacauggagacccugaacaugaccaugccgcucagcugcacgaagaacuccagccaccacuacauccgggucggcaacgagaccggccuggagcugacccucaccaacacguccaucaucaaccacaaguucugcaaccugagcgacgcccacaagcgcaaccuguacgaccacgcccucauguccauccugagcaccuuccaccuguccauccccaacuucaaccaguacgaggccaugagcugcgacuucaacgggggcaagaucuccgugcaguacaaccucagccacgccuacgcgguggacgccgccgagcacugcgggaccgucgccaacggcgugcugcagaccuucaugcggauggcguggggcggguccuacaucgcccuggacagcggccgcgggaacugggacugcaucaugacguccuaccaguaccucaucauccagaacaccaccugggaggaccacugccaguucagccggcccucccccaucggcuaccuggggcugcucagccagcgcacccgggacaucuacaucagccgccggcugcugggcacguucaccuggacccucuccgacagcgagggcaacgagacccccgggggcuacugccugacgcgcuggaugcugaucgaggccgagcucaagugcuucgggaacaccgccguggccaagugcaacgagaagcacgacgaggaguucugcgacaugcugcggcuguucgacuucaacaagcaggcgauccagcgccucaaguccgaggcccagaugagcauccagcugaucaacaaggccgucaacgcccugaucaacgaccagcucaucaugaagaaccaccuccgggacaugaugggcauccccuacugcaacuacuccaaguacugguaccugaaccacaccagcuccgggcgcaccagccugcccaagugcuggcugguguccaacggcagcuaccugaacgagacgcacuucuccgacgacaucgagcagcaggccgacaacaugaucaccgagaugcuccagaaggaguacaucgaccggcagggcaagaccccgcuggggcugguggaccucuucgucuucagcaccuccuucuaccugaucagcaucuuccugcaccugaucaagaucccgacgcaccgccacaucgugggcaagcccugccccaagccccaccggcucaaccacauggggaucugcuccugcggccuguacaagcagccgggggugcccacccgcuggaagcgguga

SEQ ID NO: 928 - RNA, 1476 nt, Artificial Sequence
  derived and/or modified CDS sequence (opt1) from Lassa virus__ANH09722__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacaacucccaccacuacauccgggugggcaacgagaccggccucgagcugacgcugaccaacaccagccucaucaaccacaaguucugcaaccuguccgacgcccacaagaagaaccuguacgaccacgcccucaugagcaucaucuccaccuuccaccugagcauccccaacuucaaccaguacgaggccauguccugcgacuucaacgacgggaagaucagcguccaguacaaccugucccacacguacgcgggcgacaccgccaaccacugcgggaccguggccaacggcgugcuccagaccuucaugcgcauggccuggggcgggagcuacaucgcgcuggacuccggccgcgggggcugggacugcaucaugacgagcuaccaguaccugaucauccagaacaccaccugggaggaccacugccaguucucccggcccagccccaucggguaccucggccugcugucccagcggacccgcgacaucuacaucagccggcgccuccugggcacguucaccuggacccuguccgacagcgaggggaaggacaccccgggcggguacugccucacgcgguggaugcugaucgaggccgagcugaagugcuucggcaacaccgccgucgccaagugcaacgagaagcacgacgaggaguucugcgacaugcuccgccuguucgacuucaacaagcaggccauccagcggcugaaggcggaggcccagaugagcauccagcucaucaacaaggccgugaacgcccugaucaacgaccagcugaucaugaagaaccaccuccgcgacaucauggggauccccuacugcaacuacuccaaguacugguaccugaaccacaccgugaccggcaagacgagccugcccaagugcuggcucgucuccaacggcagcuaccugaacgagacccacuucuccgacgacaucgagcagcaggccgacaacaugaucaccgagaugcugcagaaggaguacauggagcggcaggggaagacgccccucggccugguggaccuguucguguucagcaccuccuucuaccugaucagcaucuuccuccaccuggucaagaucccgacccaccgccacgugguggggaagcccugccccaagccccaccggcugaaccacaugggcaucugcuccugcggguucuacaagcagccgggcguccccgugcgcuggaagcgguga

SEQ ID NO: 929 - RNA, 1476 nt, Artificial Sequence
  derived and/or modified CDS sequence (opt1) from Lassa virus__ANH09724__GPC
augggccagaucgugaccuucuuccaggaggucccccacgugaucgaggaggugaugaacaucguccugaucgcccucagcauccuggccgugcugaaggggcucuacaacguggcgaccugcggccugaucgggcuggucacguuccuccugcugugcggccgcuccugcaccaccacccucuacaaggggguguacgagcugcaggcccuggagcucaacauggagacgcugaacaugaccaugccgcugagcugcaccaagaacgacucccaccacuacaucauggugggcaacgagaccggccucgagcugacgcugaccaacaccagcaucaucucccacaaguucugcaaccucagcgacgcccacaagcagaaccuguacgaccacgcccugauguccaucaucagcaccuuccaccucuccauccccaacuucaaccaguacgaggccaugagcugcgacuucaacgggggcaagaucuccguccaguacaaccugagccacacguacgcgggggacgccgccaaccacugcggcaccguggccaacggggugcugcagaccuucaugcggauggcguggggcggcuccuacaucgcccucgacagcgggcgcggcgggugggacugcaucaugaccuccuaccaguaccugaucauccagaacacgaccugggaggaccacugccaguucagccggcccucccccaucggcuaccugggccuccugagccagcgcacccgggacaucuacaucucccgccggcugcucgggaccuucacguggacccugagcgacagcgagggcaaggacacccccgggggcuacugccugacccgcuggaugcucaucgaggccgagcugaagugcuucgggaacacggccgucgccaagugcaacgagaagcacgacgaggaguucugcgacaugcugcggcuguucgacuucaacaagcaggcgauccagcgccugaaggccgaggcccagauguccauccagcugaucaacaaggccgugaacgcccucaucaacgaccagcugaucaugaagaaccaccuccgggacaucaugggcauccccuacugcaacuacagcaaguacugguaccucaaccacaccgugaccggcaagaccucccugcccaagugcuggcuggucagcaacggguccuaccucaacgagacgcacuucagcgacgacaucgagcagcaggcggacaacaugaucaccgagaugcugcagaaggaguacauggagcgccagggcaagaccccgcuggggcucguggaccuguucguguucuccaccagcuucuaccugaucuccaucuuccugcaccucgucaagaucccgacgcaccggcacguggugggcaagcccugccccaagccccaccgccugaaccacauggggaucugcagcugcggcuucuacggccagccggggguccccgugcgguggaagcgcuga

SEQ ID NO: 930 - RNA, 1476 nt, Artificial Sequence
  derived and/or modified CDS sequence (opt1) from Lassa virus__ANH09728__GPC
augggccagaucgugaccuucuuccaggaggucccccacgugaucgaggaggugaugaacaucguccugaucgcccucagcgugcuggccgugcugaaggggcucuacaacgucgcgaccugcggccugaucgggcuggugacguuccuccugcugugcggccgcuccugcaccaccacccucuacaaggggguguacgagcugcaggcccuggagcucaacaugggcacgcugaacaugaccaugccgcugagcugcaccaagaacaacucccaccacuacaucauggucggcaacgagaccgggcucgagcugacgcugaccaacaccagcaucaucaaccacaaguucugcaaccucuccgacgcccacaagaaggaccuguacgaccacgcccugaugagcaucaucuccaccuuccaccucagcgugcccaacuucaaccaguacgaggccauguccugcgacuucaacggcgggaagaucagcgugcaguacaaccugucccacgcguacgccggcgacacggccaaccacugcgggaccgucgccaacggcgugcugcagaccuucaugcggauggcguggggcgggagcuacaucgcccucgacuccggccgcgggggcugggacugcaucaugaccagcuaccaguaccugaucauccagaacacgaccugggaggaccacugccaguucucccggcccagccccaucggcuaccuggggcuccugucccagcgcacccgggacaucuacaucagccgccggcugcucggcaccuucacguggacccuguccgacagcgagggggaguacaccccgggcggguacugccugacccgcuggaugcucaucgaggccgagcugaagugcuucggcaacacggccguggccaagugcaacgagaagcacgacgaggaguucugcgacaugcugcggcuguucgacuucaacaagcaggcgauccagcgccugaaggccgaggcccagaugagcauccagcugaucaacaaggccgucaacgcccucaucaacgaccagcugaucaugaagaaccaccuccgggacaucaugggcauccccuacugcaacuacuccaaguacugguaccucaaccacaccgugaccgggaagaccagccugcccaagugcuggcugguguccaacggcagcuaccucaacgagacgcacuucuccgacgacaucgagcagcaggcggacaacaugaucaccgagaugcugcagaaggaguacauggagcgccaggggaagacgccccugggccucgucgaccuguucguguucagcaccuccuucuaccugaucagcaucuuccugcaccucgugaagaucccgacccaccggcacgucguggggaagcccugccccaagccccaccgccugaaccacaugggcaucugcuccugcggcuucuacaagcagccgggggugcccguccgguggaagcgcuga

SEQ ID NO: 931 - RNA, 1476 nt, Artificial Sequence
  derived and/or modified CDS sequence (opt1) from Lassa virus__ANH09730__GPC
augggccagaucgugaccuucuuccaggaggucccccacgugaucgaggaggugaugaacaucguccugaucgcccucagcgugcuggccgugcugaaggggcucuacaacgucgcgaccugcggccugaucgggcuggugacguuccuccugcugugcggccgcuccugcaccaccacccucuacaaggggguguacgagcugcaggcccuggagcucaacauggagacgcugaacaugaccaugccgcugagcugcaccaagaacaacucccaccacuacaucauggucggcaacgagaccggccucgagcugacgcugaccaacaccagcaucaucaaccacaaguucugcaaccucuccgacgcccacaagaagaaccuguacgaccacgcccugaugagcaucaucuccaccuuccaccucagcauccccaacuucaaccaguacgaggccauguccugcgacuucaaccaggggaagaucagcgugcaguacaaccugucccacgcguacgccggcgacgccgccaaccacugcgggacgguggcgaacggcguccugcagaccuucaugcggauggccuggggcgggagcuacaucgcccucgacuccggccgcgggggcugggacugcaucaugaccagcuaccaguaccugaucauccagaacaccacgugggagaaccacugccaguucucccggcccagccccaucggguaccugggccuccugucccagcgcacccgggacaucuacaucagccgccggcugcucggcaccuucaccuggacgcuguccgacagcgaggggaagggcacccccgggggcuacugccugacccgcuggaugcucaucgaggccgagcugaagugcuucgggaacaccgccguggcgaagugcaacgagaagcacgacgaggaguucugcgacaugcugcggcuguucgacuucaacaagcaggccauccagcgcuucaaggccgaggcccagaugagcauccagcugaucaacaaggccgugaacgcgcugaucaacgaccagcucaucaugaagaaccaccuccgggacaucaugggcauccccuacugcaacuacuccaaguacugguaccugaaccacacggucaccggcaagaccagccuccccaagugcuggcugguguccaacgggagcuaccugaacgagacccacuucuccgacgacaucgagcagcaggccgacaacaugaucacggagaugcuccagaaggaguacauggagcgccagggccggaccccgcuggggcugguggaccucuucgucuucagcaccuccuucuaccugaucagcaucuuccugcaccuggugaagaucccgacccaccgccacguggucggcaagcccugccccaagccccaccggcucaaccacauggggaucugcuccugcggcuucuacaagcagccgggcgugcccgugcgcuggaagcgguga

SEQ ID NO: 932 - RNA, 1476 nt, Artificial Sequence
  derived and/or modified CDS sequence (opt1) from Lassa virus__ANH09732__GPC
augggccagaucgugaccuucuuccaggaggucccccacgugaucgaggaggugaugaacaucguccugaucgcccucagcauccuggccgugcugaaggggguguacaacgucgcgaccugcggccucaucgggcuggugacguuccugcuccuguccggccgcagcugcaccaccaccaucuacaaggggguguacgagcugcaggcccucgagcugaacauggagacgcugaacaugaccaugccgcucuccugcaccaagaacaacagccaccacuacaucauggucggcaacgagaccggccuggagcugacgcucaccaacaccuccaucaucaaccacaaguucugcaaccugagcgacgcccacaagaagaaccuguacgaccacgcccucauguccaucaucagcaccuuccaccuguccauccccaacuucaaccaguacgaggccaugagcugcgacuucaacgggggcaagaucuccgugcaguacaaccugagccacacguacgcgggggacgccgccaaccacugcggcaccguggccaacgggguccuccagaccuucaugcggauggcguggggcggcuccuacaucgcccuggacagcgggcacggcgggugggacugcaucaugaccuccuaccaguaccugaucauccagaacacgaccugggagaaccacugccaguucagccgccccucccccaucggcuaccucggccugcugagccagcggacccgcgacaucuacaucucccggcgccuccuggggaccuucacguggacccugagcgacagcgagggcaaggacacccccgggggcuacugccucacccgguggaugcugaucgaggccgagcugaagugcuucgggaacacggccguggccaagugcaacgagaagcacgacgaggaguucugcgacaugcuccgccuguucgacuucaacaagcaggcgauccagcggcugaaggccgaggcccagauguccauccagcucaucaacaaggccgugaacgcccugaucaacgaccagcugaucaugaagaaccaccuccgcgacaucaugggcauccccuacugcaacuacagcaaguacugguaccugaaccacaccgucaccggcaagaccucccugcccaagugcuggcucgugagcaacggguccuaccugaacgagacgcacuucagcgacgacaucgagcagcaggcggacaacaugaucaccgagaugcugcagaaggaguacauggagcggcagggcaagaccccgcucgggcugguggaccuguucgucuucuccaccagcuucuaccucaucuccaucuuccugcaccuggugaagaucccgacgcaccgccacaucgugggcaagcccugccccaagccccaccggcugaaccacauggggaucugcagcugcggcuucuacaagcagccgggcguccccgugcgcuggaagcgguga

SEQ ID NO: 933 - RNA, 1473 nt, Artificial Sequence
  derived and/or modified CDS sequence (opt1) from Lassa virus__ANH09738__GPC
augggccagaucgugaccuucuuccaggaggucccccacgugaucgaggagaucaugaacaucgugcugaucacccucagccugcuggccauccucaaggggcuguacaacuucgccacgugcggccugaucgggcucaucaccuuccuguuccugugcggccgcuccugcagcaugaucuacaagggguccuaccagcucgagacccuggagcugaacauggagacccucaacaugacgaugccgcugagcugcaccaagaacaacucccaccacuacauccgggucggcaacgagaccggccuggagcucacccugacgaacaccagcaucaucaaccacaaguucugcaaccuguccgacgcgcacaagcgcaaccucuacgaccacagccugauguccaucaucagcaccuuccaccuguccauccccaacuucaaccaguacgaggccaugagcugcgacuucaacgggggcaagaucuccauccaguacaaccucagccacaccuacgccggggacgccgccaagcacugcggcacgguggcgaacggggugcugcagaccuucaugcggauggccuggggcggcuccuacaucgcccuggacagcgggcgcggcaacugggacugcaucaugaccuccuaccaguaccucaucauccagaacaccacgugggaggaccacugccaguucagccggcccucccccaucggguaccugggccugcucagccagcgcacccgggacaucuacaucagccgccggcugcugggcaccuucaccuggacgcucuccgacagcgaggggaaggagaccccgggcggguacugccugacccgcuggaugcugaucgaggccgagcucaagugcuucggcaacaccgcggucgccaagugcaacgagaagcacgacgaggaguucugcgacaugcugcggcuguucgacuucaacaagcaggccauccagcgccucaagacggaggcccagauguccauccagcugaucaacaaggccgugaacgcgcugaucaacgaccagcucaucaugaagaaccaccuccgggacaucauggggauccccuacugcaacuacagcaaguacugguaccugaaccacaccuccaccggccgcaccagccugcccaagugcuggcugguguccaacggcagcuaccugaacgagacgcacuucuccgacgacaucgagcagcaggccgacaacaugaucaccgagaugcuccagaaggaguacaucgaccggcaggggaagacgccccugggccuggucgacguguucauguucagcaccuccuucuaccucaucagcaucuuccugcaccuggugaagaucccgacccaccgccacaucgucgggaaguccugccccaagccccaccggcugaaccacaugggcaucugcagcugcgggcucuacaagcagcccggcgugccggugcgcuggaagcgguga

SEQ ID NO: 934 - RNA, 1473 nt, Artificial Sequence
  derived and/or modified CDS sequence (opt1) from Lassa virus__ANH09740__GPC
augggccagaucgugaccuucuuccaggaggucccccacgugaucgaggaggugaugaacaucguccugaucgcccucagccugcuggccauccucaaggggcuguacaacuucgcgaccugcggcgugaucgggcugaucacguuccuccugcugugcggccgcuccugcagcgccaccuacaaggggcaguacgagcuccagacccuggagcugaacauggagucccucaacaugaccaugccgcugagcugcacgaagaacaacucccaccacuacauccgggccggcaacaacaccggccuggagcucacccugaccaacacgagcaucaucucccacaaguucugcaaccugagcgacgcccacaagaagaaccucuacgaccacacccugauguccaucaucaccaccuuccaccugagcauccccaacuucaaccaguacgaggccauguccugcgacuucaacgggggcaagaucagcauccaguacaaccucucccacagcuacgcgggggacgccgcccagcacugcggcacgguggccaacgggguccugcagaccuucaugcgcauggcguggggcggcuccuaccuggcccucgacagcgggcggcgcggcugggacugcaucaucuccagcuaccaguaccugaucauccagaacaccaccugggacgaccacugccaguucucccggcccagccccaucggguaccugggcuucgugagccagaagacgcgcgacaucuacaucucccggcgccuccugggcaccuucaccuggacccugagcgacuccgaggggcacgacaugccgggcggguacugccucacgcgguggaugcugaucgaggccgaccugaagugcuucggcaacaccgccguggccaagugcaacgagaagcacgacgaggaguucugcgacauguggcgccucuucgacuucaacaagcaggcgauccagcggcugaaggccgaggcccagaugaacauccagcugaucaacaaggccgucaacgcccucaucaacgaccagcugaugaugaagaaccaccuccgcgacaucauggggauccccuacugcaacuacagcaaguucugguaccugaacaacaccaccacgggccggaccucccugccccgcugcuggcugaucagcaacggcuccuaccucaacgagacccacuucagcgacgacaucgagcagcaggcggacaacaugaucaccgagaugcugcagaaggaguacauggaccggcaggggaagacgccccugggccucguggaccuguucguguucuccaccagcuucuaccugaucaccaucuuccuccaccuggucaagaucccgacccaccgccacaucguggggaagcccugccccaagccccaccggcugaaccacaugggcaucugcuccugcgggcuguacaagcagccgggcgugcccguccgcuggaagcgguga

SEQ ID NO: 935 - RNA, 1473 nt, Artificial Sequence
  derived and/or modified CDS sequence (opt1) from Lassa virus__CAA36645__GPC
augggccagaucgugaccuucuuccaggaggucccccacgugaucgaggaggugaugaacaucguccugaucgcccucagcauccuggccauccugaaggggcucuacaacguggcgaccugcggccugaucgggcuggugacguuccuccugcuguccggccgcagcugcucccucaucuacaaggggaccuacgagcugcagacccuggagcucaacauggagacccugaacaugacgaugccgcugagcugcaccaagaacaacucccaccacuacauccgggucggcaacgagaccggccucgagcugacccugacgaacaccagcauccucaaccacaaguucugcaaccuguccgacgcccacaagcgcaaccuguacgaccacagccucauguccaucaucagcaccuuccaccuguccauccccaacuucaaccaguacgaggccaugagcugcgacuucaacgggggcaagaucaccgugcaguacaaccugucccacagcuucgccguggacgccgcggggcacugcggcacgcucgccaacgggguccugcagaccuucaugcggauggccuggggcggcuccuacaucgcccuggacagcgggcgcggcaacugggacugcaucaugaccuccuaccaguaccucaucauccagaacaccacgugggacgaccacugccaguucagccggcccucccccaucggguaccugggccugcucagccagcgcacccgggacaucuacaucagccgccggcugcugggcaccuucaccuggacgcucuccgacagcgaggggaacgagaccccgggcggguacugccugacccgcuggaugcugaucgaggcggagcucaagugcuucggcaacaccgccguggccaagugcaacgagaagcacgacgaggaguucugcgacaugcugcggcuguucgacuucaacaagcaggccauccgccggcucaagacggaggcccagauguccauccagcugaucaacaaggcggugaacgcccugaucaacgaccagcucaucaugaagaaccaccuccgcgacaucauggggauccccuacugcaacuacagccgguacugguaccugaaccacaccuccaccggcaagaccagccugccccgcugcuggcugaucuccaacggcagcuaccugaacgagacgaaguucuccgacgacaucgagcagcaggccgacaacaugaucaccgagaugcuccagaaggaguacaucgaccggcaggggaagacgccccugggccuggucgaccuguucguguucagcaccuccuucuaccucaucagcaucuuccugcaccuggugaagaucccgacccaccgccacaucgucgggaagcccugccccaagccccaccggcucaaccacaugggcaucugcuccugcgggcuguacaagcagccgggcgugcccgugcgcuggaagcgguga

SEQ ID NO: 936 - RNA, 1476 nt, Artificial Sequence; identical to SEQ ID NO: 756
  derived and/or modified CDS sequence (opt1) from Lassa virus__NP_694870__GPC

SEQ ID NO: 937 - RNA, 1713 nt, Artificial Sequence
  derived and/or modified CDS sequence (opt1) from Lassa virus__AAA46284__NP
augagcgccuccaaggaggugcgcagcugccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagaagcgggacgacggcgaccugaagcgccugcgggaccucaaccaggccgugaacaaccugguggagcugaaguccacccagcagaaguccguccuccgcguggggacgcugagcuccgacgaccugcucauccuggccgccgaccuggagaagcucaagagcaaggugacccggaccgagcgcccccuguccagcggcgucuacauggggaaccuguccagccagcagcucgaccagcggcgcgcccugcugaacaugaucggcaugaccggcguguccgggggcgggaagggcgcgagcaacgggaucgugcgggucugggacgugaagaacgccgagcuccugaacaaccaguucggcacgaugccgucccugacccucgccugccugaccaagcagggccagguggaccugaacgacgccguccaggcgcucaccgaccuggggcugaucuacacggccaaguaccccaacagcagcgaccucgaccgccugucccagagccaccccauccugaacaugaucgacaccaagaaguccagccucaacaucuccggcuacaacuucagccugggggccgccgugaaggccggcgcgugcaugcuggacggcgggaacaugcucgagaccaucaaggugagcccccagaccauggacggcauccucaagagcauccugaaggucaagaagucccuggggauguucgugagcgacacgccgggcgagcggaaccccuacgagaacauccuguacaagaucugccuguccggggacggcuggagcuacaucgccucccgcaccagcaucgugggccgggccugggagaacaccgucguggaccucgagcaggacaacaagccccagaagaucgggaacggcggguccaacaagagccugcaguccgccggcuucgccgcggggcugaucuacagccagcucaugacccugaaggacuucaagugcuucaaccugauccccaacgccaagacguggauggacaucgagggccgcccggaggaccccguggagaucgcccuguaccagcccuccagcggcugcuacguccacuucuuccgggagcccaccgaccucaagcaguucaagcaggacgccaaguacagccacgggcgcgacgugaccgaccuguucgccgcgcagccgggccugaccuccgccgucaucgaggcccucccccggaacauggugaucacgugccaggggagcgaggacauccgcaagcugcuggagucccagggccgccgggacaucaagcucaucgacaucacccugagcaaggccgacucccgcaaguucgagaacgccgugugggaccaguucaaggaccugugccacaugcacaccggggucgugguggagaagaagaagcggggcggcaaggaggagaucacgccccacugcgcgcucauggacugcaucauguucgacgccgccgucagcgggggccuggacgccaaggugcugcgcgugguccucccccgggacaugguguuccgcaccuccaccccgaaggugguccuguga

SEQ ID NO: 938 - RNA, 1710 nt, Artificial Sequence
  derived and/or modified CDS sequence (opt1) from Lassa virus__AAF86704__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgaggugaacaacguccagcgccucaugcggaagcagaagcgcgacgacggcgaccugaagcggcugcgcgaccucaaccaggccgugaacaaccugguggagcugaaguccacccagcagaaguccauccuccgggucgggacgcugaccagcgacgaccugcucacccuggccgccgaccuggagaagcucaagagcaaggugauccgcaccgagcggccccuguccagcggcguguacauggggaaccuguccacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccugggccucaucuacaccgcgaaguaccccaacuccagcgaccuggaccgccugucccagagccacccgauccucaacaugguggacaccaagaaguccagccugaacaucagcggguacaacuucucccugggcgccgccgugaaggccggggccugcaugcucgacggcggcaacaugcuggagacgaucaaggucacgccccagaccauggacgggauccucaagagcauccugaaggugaagcggucccugggcauguucgugagcgacacccccggggagcgcaaccccuacgagaacauccuguacaagaucugccucuccggcgacggguggccguacaucgcgagccggaccuccaucgucggccgcgccugggagaacaccaccguggaccuggagagcgacggcaagccccagaagguggggaccgccggcuccaacaagagccugcaguccgccggguuccccacgggccucaccuacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccacggaccugaagcaguucaagcaggacgccaaguacagccacggcaucgacguggccgaccuguucccggcccagcccgggcucaccuccgccgucaucgaggcgcugccccggaacauggugcugaccugccagggcagcgacgacaucaagaagcuccuggacucccaggggcgccgcgacaucaagcugaucgacaucagccucagcaagguggacucccggaaguucgagaacgccgucugggaccagugcaaggaccugugccacaugcacaccggcgugguggucgagaagaagaagcgcgggggcaaggaggagaucacgccccacugcgcccugauggacugcaucauguucgacgccgccgugagcggcgggcucaacaucccggugcugcgggcgguccugccccgcgacaugguguuccggaccuccagccccaaggugguccucuga

SEQ ID NO: 939 - RNA, 1710 nt, Artificial Sequence
  derived and/or modified CDS sequence (opt1) from Lassa virus__AAO59513__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaaggagcgccgggacgacagcgaccugaagcgccugcgggaccucaaccaggccgugaacaaccugguggagcugaaguccacccagcagaaguccguccuccgcgugggcacccugaccagcgacgaccugcucgugcuggccgccgaccuggagaagcuccggagcaaggucacccgcaccgagcggccccuguccgccgggguguacaugggcaaccugagcucccagcagcucgaccagcgccgggcgcugcugagcaugaucgggaugaacggcuccaaccagggcgcccgcgccgggcgggacggcgugguccgcgugugggacgugaagaacgccgagcuccugaacaaccaguucgggaccaugccgagccugacccucgcgugccugaccaagcagggccaggucgaccugaacgacgccgugcaggcccucaccgaccuggggcugaucuacacggccaaguaccccaacaccuccgaccucgaccggcugacccagagccaccccauccugaacaugaucgacaccaagaaguccagccucaacgugagcggcuacaacuucucccugggcgccgcggucaaggccggggccugcaugcuggacggcgggaacaugcucgagacgaucaaggugagcccccagaccauggacggcauccugaaguccauccugaaggugaagaaggcccucggcauguucaucagcgacaccccgggggagcgcaaccccuacgagaacauccuguacaagaucugccuguccggcgacggguggcccuacaucgccagccggaccuccaucacgggccgcgcgugggagaacaccgucguggaccucgagagcgacgagaagccccagaaggccggguccaacaacagcaacaagucccugcagagcgccggcuucaccgccggccugaccuacucccagcucaugacgcugaaggacgccaugcugcagcuggacccgaacgcgaagaccuggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacaucaccgaccuguucgccgcccagcccggccucacguccgcggucaucgacgcccugccccgcaacauggugaucacgugccaggggagcgacgacauccggaagcugcucgagagccagggccgcaaggacaucaagcugaucgacaucgcccugaacaaggccgacucccggaaguacgagaacgcggucugggaccaguacaaggaccucugccacaugcacaccggcgugguggucgagaagaagaagcgcgggggcaaggaggagaucacgccccacugcgcccugauggacugcaucauguucgacgccgccgugagcgggggccugaagacccucgugcugcgggccguccugccgcgcgacaugguguuccggaccuccacgccccgcgugguccucuga

SEQ ID NO: 940 - RNA, 1710 nt, Artificial Sequence
  derived and/or modified CDS sequence (opt1) from Lassa virus__AAT48999__NP
augagcguguccaaggagaucaagagcuuccuguggacccagucccuccgccgggagcugagcggcuacugcuccaacaucaagcugcaggucgugaaggacgcccaggcccuccugcacgggcuggacuucagcgagguguccaacguccagcgccucaugcggaagcagcgccgggacgacaacgaccugaagcgccugcgggaccucaaccaggcggugaacaaccugguggagcucaagagcacccagcagaaguccguccugcgcgugggcacgcugaccagcgacgaccugcucauccuggccgccgaccuggagaagcucaaguccaaggugacccggaccgagcgcccccugagcgccggggucuacaugggcaaccuguccagccagcagcucgaccagcggcgcgcccugcugaacaugaucgggauguccggcggcaaccagggggcgcagacgggccgggacgggguggugcgcaucugggacgucaagaacgccgagcuccugaacaaccaguucggcaccaugccgagccugacccucgccugccugaccaagcagggccagguggaccugaacgacgugguccaggcccucacggaccuggggcugaucuacaccgcgaaguaccccaacaccuccgaccucgaccggcugacccagagccaccccauccugaacaugaucgacacgaagaaguccagccucaacaucagcggcuacaacuucucccugggggccgccgugaaggccggcgccugcaugcuggacgggggcaacaugcucgagaccaucaaggugagcccccagaccauggacggcauccugaaguccauccugaaggucaagaaggcgcucgggauguucaucagcgacaccccgggcgagcgcaaccccuacgagaacauccuguacaagaucugccuguccggggacggcuggcccuacaucgccagccggacguccaucaccgggcgcgccugggagaacaccgugguggaccucgagagcggcgagaagccccagaagaucggcuccaacaacagcaacaagugccugcaguccgccggguucaccgccggccugagcuacucccagcucaugacgcugaaggacgcgaugcugcagcuggacccgaacgccaagaccuggauggacaucgaggggcggcccgaggaccccgucgagaucgcccucuaccagcccagcuccggcugcuacauccacuucuuccgcgagccgaccgaccugaagcaguucaagcaggacgccaaguacagccacgggaucgacgugaccgaccuguucgccgcgcagcccggccucacguccgccgugaucgaggcccugccccggaacauggucaugaccugccagggcagcgacgacauccgcaagcugcucgagucccaggggcgcaaggacaucaagcugaucgacaucgcccugagcaagaccgacagccggaaguacgagaacgccgugugggaccaguacaaggaccucugccacaugcacaccggcgucgugguggagaagaagaagaagggcgggaaggaggagaucacgccccacugcgcgcugauggacugcaucauguucgacgccgccgucuccgggggccugaacaccagcgugcuccgcgccgugcugccgcgggacauggucuuccgcaccuccacccccaagguggugcuguga

SEQ ID NO: 941 - RNA, 1710 nt, Artificial Sequence
  derived and/or modified CDS sequence (opt1) from Lassa virus__AAT49007__NP
augagcguguccaaggagaucaagagcuuccuguggacccagucccuccgccgggagcugagcggcuacugcuccaacaucaagcugcaggucgugaaggacgcccaggcccuccugcacgggcuggacuucagcgagguguccaacguccagcgccucaugcggaagcagcgccgggacgacaacgaccugaagcgccugcgggaccucaaccaggcggugaacaaccugguggagcucaagagcacccagcagaaguccguccugcgcgugggcacgcugaccagcgacgaccugcucauccuggccgccgaccuggagaagcucaaguccaaggugacccggaccgagcgcccccugagcgccgggaucuacaugggcaaccuguccagccagcagcucgaccagcggcgcgcccugcugaacaugaucgggauguccggcggcaaccagggggcgcagacgggccgggacggggucgugcgcaucugggacgugaagaacgccgagcuccugaacaaccaguucggcaccaugccgagccugacccucgccugccugaccaagcaggggcaggucgaccugaacgacguggugcaggcccucacggaccugggccugaucuacaccgcgaaguaccccaacaccuccgaccucgaccggcugacccagagccaccccauccugaacaugaucgacacgaagaaguccagccucaacaucagcggcuacaacuucucccugggggccgccgucaaggccggcgccugcaugcuggacgggggcaacaugcucgagaccaucaaggugagcccccagaccauggacggcauccugaaguccauccugaaggugaagaaggcgcucgggauguucaucagcgacaccccgggcgagcgcaaccccuacgagaacauccuguacaagaucugccuguccggggacggcuggcccuacaucgccagccggacguccaucaccgggcgcgccugggagaacaccgucguggaccucgagagcggcgagaagccccagaagaucggcuccaacaacagcaacaagucccugcagagcgccggguucaccgccggccugacguacucccagcucaugacccugaaggacgcgaugcugcagcuggacccgaacgccaagaccuggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacgucacggaccuguucgccgcgcagcccggccucaccuccgccgugaucgaggcccugccccggaacauggugaugaccugccagggcagcgacgacauccgcaagcugcucgagucccaggggcgcaaggacaucaagcugaucgacaucgcccugagcaagaccgacagccggaaguacgagaacgccgucugggaccaguacaaggaccucugccacaugcacacgggcguggucguggagaagaagaagaagggcgggaaggaggagaucacgccccacugcgcgcugauggacugcaucauguucgacgccgccgccuccgggggccugaacacccucgugcugcgcgcgguccugccgcgggacaugguguuccgcaccagcacccccaaggugguccucuga

SEQ ID NO: 942 - RNA, 1710 nt, Artificial Sequence
  derived and/or modified CDS sequence (opt1) from Lassa virus__AAT49009__NP
augagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaaguccguccugcgcguggggacccugaacagcgacgaccugcucgugcuggccgccgaccuggagaagcucaaguccaaggucauccggaccgagcgcccccugagcuccggcaucuacauggggaaccugagcucccagcagcucgaccagcggcgcgcccugcugaacaugaucggcaugaccggcgggaaccggggcgggggcaccagcuccgacgggaucgugcgcgugugggacgucaagaacgcggagcuccugaacaaccaguucggcacgaugccgagccugacccucgccugccugaccaagcagggccagguggaccugaacgacgccgugcaggcccucaccgaccuggggcugaucuacacggcgaaguaccccaacuccagcgaccucgaccggcuggcccagagccaccccauccugaacaugaucgacaccaagaaguccagccucaacaucuccggcuacaacuucagccugggggccgccgucaaggccggcgcgugcaugcuggacggcgggaacaugcucgagaccaucaaggugagcccccagaccaucgacggcauccugaagacgauccugaaggugaagaagucccucgggauguucaucagcgacgucccgggcgagcgcaaccccuacgagaacauccuguacaagaucugccugagcggggacggcuggcccuacaucgccucccggaccagcaucgugggccgcgccugggagaacaccguggucgaccucgaguccgacaacaagccccagaagaccgggaacggcgggagcaacaagucccugcagagcgccggcuucgccgcggggcugacguacucccagcucaugacccugaaggacagcaugcugcagcuggacccgaacuccaagaccuggauggacaucgagggccggcccgaggaccccguggagaucgcccucuaccagcccaacagcggcugcuacauccacuucuuccgcgagccgaccgaccugaagcaguucaagcaggacgccaaguacucccacgggaucgacgugacggaccuguucgccgcccagcccggccucaccagcgcggucaucgaggcccugccccggaacauggugaucacgugccaggggagcgaggacauccgcaagcugcucgagucccagggccgccgggacaucaagcugaucgacaucagccugaacaaggccgacucccgcaaguucgagaacgccgucugggaccaguucaaggaccucugccacaugcacaccggggugguggucgagaagaagaagcggggcggcaaggaggagaucacgccccacugcgcccugauggacugcaucauguucgacgcggccgugagcgggggccuggacgccaaggugcuccgcgccguccugccgcgggacaugguguuccgcaccuccacccccaaggugguccuguga

SEQ ID NO: 943 - RNA, 1710 nt, Artificial Sequence
  derived and/or modified CDS sequence (opt1) from Lassa virus__ADI39452__NP
augagcguguccaaggaggucaagagcuuccuguggacccagucccuccgccgggagcugagcggcuacugcuccaacaucaagcuccagguggugaaggacgcccaggcccugcugcacgggcuggacuucagcgaggucuccaacgugcagcgccucaugcggaagcagcgccgggacgacaacgaccugaagcgccugcgggaccucaaccaggcggugaacaaccuggucgagcucaagagcacccagcagaaguccgugcugcgcgugggcacccugaccagcgacgaccugcucauccuggccgccgaccuggagaagcucaagaccaaggucacccggacggagcgcccccuguccgccgggguguacaugggcaaccugagcucccagcagcucgagcagcggcgcgcccugcugaacaugaucgggaugaacggcggcaaccagggggugcaggcgggccgggacggggucgugcgcgugugggacgucaagaacgccgagcuccugaacaaccaguucggcaccaugccgagccugacccucgccugccugaccaagcagggccagguggaccugaacgacgccgugcaggcgcucacggaccuggggcugaucuacaccgccaaguaccccaacaccuccgaccucgaccggcuggcccagagccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccugaaguccauccugaaggugaagcgcacccucgggauguucgucagcgacaccccgggcgagcggaaccccuacgagaacauccuguacaagaucugccuguccggggacggcuggcccuacaucgccagccgcacguccaucaccgggcgggccugggagaacaccaucguggaccucgagagcgacggcaagccccagaaggugggcaacaacggguccaacaagagccugcaguccgccggcuucaccgcggggcugacguacagccagcucaugacccugaaggacgccaugcugcagcuggacccgaacgccaagaccuggauggacaucgagggccgccccgaggaccccgucgagguggcccucuaccagcccuccagcgggugcuacauccacuucuuccgggagccgaccgaccugaagcaguucaagcaggacgccaaguacucccacggcaucgacgucacggaccuguucgcggcccagcccggccucaccagcgccgugaucgaggcccugccccgcaacauggugaucacgugccagggguccgaggacguccgcaagcugcucgagagccagggccggaaggacaucaagcugaucgacaucgcccuguccaaggcggacagccgcaaguacgagaacgccgugugggaccaguacaaggaccucugccacaugcacaccgggguggucguggagaagaagaagcggggcgggaaggaggagaugacgccccacugcgcccugauggacugcaucauguucgacgccgcgguguccggcggccugagcacccagguccuccgcgccgugcugccgcgggacaugguguuccgcaccagcacccccaaggucgugcuguga

SEQ ID NO: 944 - RNA, 1710 nt, Artificial Sequence
  derived and/or modified CDS sequence (opt1) from Lassa virus__ADU56611__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugaccagcgacgaccugcucacccuggccgccgaccuggagaagcucaaguccaaggugauccgcaccgagcggccccugagcuccggcgucuacauggggaaccugagcacgcagcagcucgagcagcgcaaggcccugcuguccaugaucggcauggugggcggggcgcagggcacccagccggggcgggacggcgugguccgcgugugggacgugaagaaccccgaccuccugaacaaccaguucgggaccaugcccagccugacccucgccugccugacgaagcagggccaggucgaccugaacgacgccgugcucgcccugaccgaccugggccucaucuacaccgcgaaguaccccaacuccagcgaccuggaccggcugucccagagccacccgauccucaacaugguggacaccaagaaguccagccugaacaucagcggguacaacuucucccugggcgccgccgucaaggccggggccugcaugcucgacggcggcaacaugcuggagacgaucaaggugacgccccagaccauggacgggauccucaagagcauccugaaggugaagcgcucccugggcauguucgucagcgacacccccggggagcggaaccccuacgagaacauccuguacaagaucugccucuccggcgacggguggccguacaucgcgagccgcaccuccaucgugggccgggccugggagaacaccaccguggaccuggagagcgacggcaagccccagaaggucgggaccgccggcuccaacaagagccugcaguccgccggguuccccacgggccucaccuacagccagcugaugacccugaaggacuccaugaugcagcuggaccccagcgccaagaccuggaucgacaucgaggggcgcccggaggaccccguggagaucgcgcucuaccagcccauguccggcugcuacauccacuucuuccgggagcccacggaccugaagcaguucaagcaggacgccaaguacagccacggcaucgacgucaccgaccuguucuccgcccagccggggcucaccagcgccgugaucgaggcccugccccgcaacauggugcugaccugccagggcagcgacgacaucaagaagcuccuggacucccaggggcggcgcgacaucaagcugaucgacaucagccucaacaaggcggacucccgccgguucgagaacgccgucugggaccagugcaaggaccugugccacaugcacacgggcgugguggucgagaagaagaagcgcgggggcaaggaggagaucacgccccacugcgcccugauggacugcaucauguucgacgccgccgugagcggcgggcucaacauccccauccugcgggcggugcugccgcgcgacauggucuuccggaccuccagccccaagguggugcucuga

SEQ ID NO: 945 - RNA, 1710 nt, Artificial Sequence
  derived and/or modified CDS sequence (opt1) from Lassa virus__ADU56615__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccggaucggcacccugagcagcgacgaccugcucauccuggccgccgaccuggagaagcucaaguccaagguggugcgcaccgagcggccccugagcuccgggaucuacaugggcaaccugagcucccagcagcucgaccagcgcaaggcccugcugaacaugaucgggaugaccggcggcaacgggggccggaacgcgaccagcgacgggaucguccgcgugugggacgugaagaacgccgagcuccugaacaaccaguucggcacgaugccgucccugacccucgccugccugaccaagcaggggcaggucgaccugaacgacgccgugcaggcgcucaccgaccugggccugaucuacacggccaaguaccccaacagcagcgaccucgaccggcuggcccagucccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagaccauggacggcauccugaaguccauccugaaggugaagcgcagccucgggauguucaucuccgacacgccgggcgagcggaaccccuacgagaacauccuguacaagaucugccugagcggggacggcuggcccuacaucgccucccgcaccagcaucguggggcgggccugggagaacaccgucguggaccucgagaccgacaacaagccccagaagacgggcaacggcggguccaacaagagccugcaguccgccggcuucgcggccgggcugaccuacagccagcucaugacccugaaggacuccaugcugcagcuggacccgaacgccaagaccuggauggacaucgagggccgccccgaggaccccguggagaucgcccucuaccagcccgucagcgggugcuacauccacuucuuccgggagccgacggaccugaagcaguucaagcaggacgccaaguacucccacggcaucgacgugaccgaccuguucgcggcccagcccggccucaccagcgccgugaucgaggcccugccccgcaacauggucaucacgugccaggggagcgaggacauccggaagcugcucgagucccagggccgccgcgacaucaagcugaucgacaucagccuguccaagguggacagccggaaguucgagaacgccgucugggaccaguucaaggaccucugccacaugcacaccgggaucgugguggagaagaagaagcgcggcgggaaggaggagaucacgccccacugcgcgcugauggacugcaucauguucgacgccgccgucuccggcggcguggacgccaaggugcugcgggcgguccucccgcgcgacaugguguuccggaccagcacccccaaggugguccuguga

SEQ ID NO: 946 - RNA, 1710 nt, Artificial Sequence
  derived and/or modified CDS sequence (opt1) from Lassa virus__ADU56619__NP
augagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugagcuccgacgaccugcucgugcuggccgccgaccuggagaagcucaagagcaaggucgugcgcaccgagcggccccuguccagcggcaucuacauggggaaccuguccagccagcagcucgaccagcgcaaggcccugcugaacaugaucggcaugaccggcgggaacggcgggcggaacaccacguccgacggcaucgugcgcgucugggacgugaagaacgcggagcuccugaacaaccaguucgggaccaugccgagccugacccucgccugccugaccaagcagggccagguggaccugaacgacgccguccaggcccucacggaccugggccugaucuacaccgcgaaguaccccaacuccagcgaccucgaccggcuggcccagagccaccccauccugaacaugaucgacaccaagaaguccagccucaacaucuccggguacaacuucagccugggcgccgccgugaaggccggggcgugcaugcuggacggcggcaacaugcucgagaccaucaaggugagcccccagacgauggacgggauccucaagagcauccugaaggucaagcgcucccugggcauguucaucagcgacaccccgggggagcggaaccccuacgagaacauccuguacaagaucugccuguccggcgacggguggcccuacaucgccagccgcaccuccaucgugggccgggccugggagaacaccguggucgaccucgagagcgacaacaagccccagaagacgggcaacgggggcuccaacaagagccugcaguccgccggguucgccgcgggccugaccuacagccagcucaugacccugaaggacuccaugcugcagcuggacccgaacgccaagaccuggauggacaucgaggggcgccccgaggaccccguggagaucgcccucuaccagcccagcuccggcugcuacauccacuucuuccgggagccgacggaccugaagcaguucaagcaggacgccaaguacagccacggcaucgacgugaccgaccuguucgccgcgcagcccgggcucaccagcgccgucaucgaggcccugccccgcaacauggugaucacgugccagggcuccgaggacauccggaagcugcucgagagccaggggcgccgcgacaucaagcugaucgacaucucccugagcaaggucgacucccggaaguucgagaacgccgugugggaccaguucaaggaccucugccacaugcacaccggcaucguggucgagaagaagaagcgcgggggcaaggaggagaucacgccccacugcgcccugauggacugcaucauguucgacgcggccgugagcggcgggguggacgccaagguccugcgggccgugcucccgcgcgacaugguguuccggaccuccacccccaaggucgugcuguga

SEQ ID NO: 947 - RNA, 1710 nt, Artificial Sequence
  derived and/or modified CDS sequence (opt1) from Lassa virus__ADU56623__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccgucgagaucgcgcuguaccagcccauguccgggugcuacauccacuucuuccgggagcccacggaccugaagcaguucaagcaggacgccaaguacagccacggcaucgacguggccgaccucuucccggcccagcccggccugaccuccgccgucaucgaggcgcugccccgcaacauggugcugaccugccaggggagcgacgacaucaagcggcuccuggacagccagggccgccgcgacaucaagcucaucgacaucgcccuguccaaggccgacagccggcgcuucgagaacgccgugugggaccagugcaaggaccugugccacaugcacaccggggucgugguggagaagaagaagcggggcgggaaggaggagaucacgccccacugcgcccucauggacugcaucauguacgacgcggccgucuccggcggccugaacaucccggugcugcgcgccgugcucccccgggacauggucuuccgcaccagcucccccaagguggugcuguga

SEQ ID NO: 948 - RNA, 1710 nt, Artificial Sequence
  derived and/or modified CDS sequence (opt1) from Lassa virus__ADU56627__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccugaacacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagucccacccgauccucaacauggucgacaccaagaaguccagccugaacaucagcggcuacaacuucagccugggggccgccgugaaggccggcgcgugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggccugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgcgaagaccuggaucgacaucgagggccgcccggaggaccccguggagaucgcccucuaccagcccaugagcgggugcuacauccacuucuuccgggagcccacggaccugaagcaguucaagcaggacgccaaguacucccacggcaucgacgucgccgaccuguucccggcccagcccggccucaccagcgcggugaucgaggcccugccccgcaacaugguccugaccugccagggguccgacgacaucaagcggcuccuggacagccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucuga

SEQ ID NO: 949 - RNA, 1710 nt, Artificial Sequence
  derived and/or modified CDS sequence (opt1) from Lassa virus__ADU56631__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacgugaccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaacaucccggugcugcgcgccgugcugccccgggacauggucuuccgcaccagcucccccaagguggugcucuga

SEQ ID NO: 950 - RNA, 1710 nt, Artificial Sequence
  derived and/or modified CDS sequence (opt1) from Lassa virus__AFY05580__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccggcggcaagccccagaaggccgacagcaacaacuccagcaagucccugcagagcgccggguucaccgccggccugaccuacucccagcucaugacccugaaggacgccaugcugcagcuggacccgaacgcgaagacguggauggacaucgaggggcggcccgaggaccccguggagaucgcccucuaccagcccagcuccggcugcuacauccacuucuuccgcgagccgaccgaccugaagcaguucaagcaggacgccaaguacagccacgggaucgacgugaccgaccuguucgccacccagcccggccucacguccgccgucaucgacgcgcugccccgcaacauggugaucacgugccagggcagcgacgacauccggaagcugcucgagagccaggggcgcaaggacaucaagcugaucgacaucgaccuguccaagaccgacagccggaaguacgagaacgccgugugggaccaguacaaggaccucugccacaugcacaccggcgucguggucgagaagaagaagcgcgggggcaaggaggagaucaccccgcacugcgcccugauggacugcaucauguucgacgccgcgguguccgggggccugaacaccagcgugcuccgggccguccugccccgcgacaugguguuccggaccuccacgccccgcgugguccuguga

SEQ ID NO: 951 - RNA, 1710 nt, Artificial Sequence
  derived and/or modified CDS sequence (opt1) from Lassa virus__AFY05581__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccggcggcaagccccagaaggccgacagcaacaacuccagcaagucccugcagagcgccggguucaccgccggccugaccuacucccagcucaugacccugaaggacgccaugcugcagcuggacccgaacgcgaagacguggauggacaucgaggggcgccccgaggaccccguggagaucgcccucuaccagcccagcuccggcugcuacauccacuucuuccgggagccgaccgaccugaagcaguucaagcaggacgccaaguacagccacgggaucgacgugaccgaccuguucgccacccagcccggccucacguccgccgucaucgacgcgcugccccgcaacauggugaucacgugccagggcagcgacgacauccgcaagcugcucgagagccaggggcggaaggacaucaagcugaucgacaucgaccuguccaagaccgacagccgcaaguacgagaacgccgugugggaccaguacaaggaccucugccacaugcacaccggcgucguggucgagaagaagaagcgcgggggcaaggaggagaucaccccgcacugcgcccugauggacugcaucauguucgacgccgcgguguccgggggccugaacaccagcgugcucaaggccguccugccccgggacaugguguuccggaccuccacgccccgcgugguccuguga

SEQ ID NO: 952 - RNA, 1710 nt, Artificial Sequence
  derived and/or modified CDS sequence (opt1) from Lassa virus__AFY05587__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccuguga

SEQ ID NO: 953 - RNA, 1710 nt, Artificial Sequence
  derived and/or modified CDS sequence (opt1) from Lassa virus__AFY05591__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgucgagcuccugagcaaccaguucggcaccaugccgucccugacgcucgccugccugaccaagcagggccagguggaccugaacgacgcggugcaggcccucaccgaccuggggcugaucuacaccgccaaguaccccaacacgagcgaccucgaccgccuggcccagucccaccccauccugaacaugaucgacaccaagaaguccagccucaacaucuccggcuacaacuucagccugggggccgcggucaaggccggcgccugcaugcuggacgggggcaacaugcucgagaccaucaaggugagcccccagaccauggacggcauccucaagagcauccugaaggugaagaaggcccuggggauguucaucuccgacacgccgggcgagcggaaccccuacgagaacauccuguacaagaucugccugagcggggacggcuggcccuacaucgccucccgcaccagcaucaccgggcgggcgugggagaacaccgucguggaccucgaguccgacggcaagccccagaaggccgacagcaacaacuccagcaagucccugcagagcgccggcuucacggccgggcugaccuacucccagcucaugacccugaaggacgccaugcugcagcuggacccgaacgcgaagaccuggauggacaucgagggccgccccgaggaccccguggagaucgcccucuaccagcccagcuccgggugcuacauccacuucuuccgggagccgacggaccugaagcaguucaagcaggacgccaaguacagccacggcaucgacgucaccgaccuguucgccacccagcccgggcucaccuccgccgugaucgacgcgcugccccgcaacauggugaucacgugccagggcagcgacgacauccgcaagcugcucgagagccagggccggaaggacaucaagcugaucgacaucgaccuguccaagaccgacagccgcaaguacgagaacgccgucugggaccaguacaaggaccucugccacaugcacaccgggguggucguggagaagaagaagcggggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcuguga

SEQ ID NO: 954 - RNA, 1710 nt, Artificial Sequence
  derived and/or modified CDS sequence (opt1) from Lassa virus__AFY05597__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccgcaagcugcucgagagccagggccggaaggacaucaagcugaucgacaucgaccuguccaagaccgacagccgcaaguacgagaacgccgugugggaccaguacaaggaccucugccacaugcacaccggggucguggucgagaagaagaagcggggcgggaaggaggagaucaccccgcacugcgcccugauggacugcaucauguucgacgccgcgguguccggcgggcugaacaccagcgugcuccgcgccguccugccccgggacaugguguuccgcaccuccacgccccgggugguccuguga

SEQ ID NO: 955 - RNA, 1710 nt, Artificial Sequence
  derived and/or modified CDS sequence (opt1) from Lassa virus__AFY05610__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacgcugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacacgaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgugaccgaccuguucgccacgcagcccgggcucaccuccgccgucaucgacgcccugccccgcaacauggugaucacgugccagggcagcgacgacauccgcaagcugcucgagagccagggccggaaggacaucaagcugaucgacaucgaccuguccaagaccgacagccgcaaguacgagaacgcggugugggaccaguacaaggaccucugccacaugcacaccggggucguggucgagaagaagaagcggggcgggaaggaggagaucaccccgcacugcgcccugauggacugcaucauguucgacgccgccguguccggcgggcugaacaccagcgugcuccgcgcgguccugccccgggacaugguguuccgcaccuccacgccccgggugguccuguga

SEQ ID NO: 956 - RNA, 1710 nt, Artificial Sequence
  derived and/or modified CDS sequence (opt1) from Lassa virus__AFY05616__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccuggcccagucccaccccauccugaacaugaucgacaccaagaaguccagccucaacaucuccggcuacaacuucagccugggggcggccgugaaggccggcgccugcaugcuggacgggggcaacaugcucgagaccaucaaggucagcccccagaccauggacggcauccucaagagcauccugaaggugaagaaggcccuggggauguucaucuccgacacgccgggcgagcggaaccccuacgagaacauccuguacaagaucugccugagcggggacggcuggcccuacaucgcgucccgcaccagcaucaccgggcgggccugggagaacaccguggucgaccucgaguccgacggcaagccccagaaggccgacagcaacaacuccagcaagucccugcagagcgccggcuucacggccgggcugaccuacucccagcucaugacccugaaggacgcgaugcugcagcuggacccgaacgccaagaccuggauggacaucgagggccgccccgaggaccccguggagaucgcccucuaccagcccagcuccgggugcuacauccacuucuuccgggagccgacggaccugaagcaguucaagcaggacgccaaguacagccacggcaucgacgugaccgaccuguucgccacccagcccgggcucaccuccgcggucaucgacgcccugccccgcaacauggugaucacgugccagggcagcgacgacauccgcaagcugcucgagagccagggccggaaggacaucaagcugaucgacaucgaccuguccaagaccgacagccgcaaguacgagaacgccgugugggaccaguacaaggaccucugccacaugcacaccggggucguggucgagaagaagaagcggggcgggaaggaggagaucacgccccacugcgcccugauggacugcaucauguucgacgcggccguguccggcgggcugaacaccagcgugcuccgcgccguccugccgcgggacaugguguuccgcaccuccacgccccgggugguccuguga

SEQ ID NO: 957 - RNA, 1716 nt, Artificial Sequence
  derived and/or modified CDS sequence (opt1) from Lassa virus__AFY05618__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcagaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccuguga

SEQ ID NO: 958 - RNA, 1710 nt, Artificial Sequence
  derived and/or modified CDS sequence (opt1) from Lassa virus__AHC95552__NP
augagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacccugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcaugacgggcgggaaccagggcacccaggcggggcgggacggcguggugcgcgucugggacgugaagaacgccgagcuccugaacaaccaguucgggaccaugccgucccugacccucgccugccugacgaagcagggccaggccgaccugaacgacgugguccaggcgcucaccgaccugggccugaucuacaccgccaaguaccccaacgccagcgaccucgaccggcugacccagucccaccccauccugaacaugaucgacacgaagaaguccagccucaacaucagcggguacaacuucagccugggcgccgccgugaaggcgggggccugcaugcuggacggcggcaacaugcucgagaccaucaaggugagcccccagagcauggacgggauccugaaguccauccugaaggucaagcgcgcccucggcauguucgugagcgacaccccgggggagcggaaccccuacgagaacauccuguacaagaucugccuguccggcgacggguggcccuacaucgccagccgcaccuccaucgugggccgggccugggagaacacggucguggaccucgaggcggacggcaaccccaagaagcugaacagcaacggguccaacaagagccugcaguccgccggcuucccggccgggcucaccuacagccagcugaugacccugaaggacgccaugcugcagcucgaccccaacgccaagaccuggauggacaucgagggccgccccgaggaccccguggaggucgcgcuguaccagccgaacuccgggugcuacauccacuucuuccgggagcccacggaccugaagcaguucaagcaggacgccaaguacagccacggcaucgacgugaccgaccucuucgccgcccagcccggccugaccuccgccgucaucgaggcgcugccccgcaacauggugaucacgugccaggggagcgaggacauccgcaagcuccuggagucccagggccggaaggacaucaagcugaucgacaucgcccucagcaagaccgacucccgcaaguucgagaacgccgugugggaccaguacaaggaccugugccacaugcacaccggggucgugguggagaagaagaagcggggcgggaaggaggagaucaccccgcacugcgcccugauggacugcaucauguucgacgcggccgucagcggcggccucaacacccuggugcugcgcgccgugcucccccgggacauggucuuccgcacgagcacgccccggguggugcuguga

SEQ ID NO: 959 - RNA, 1710 nt, Artificial Sequence
  derived and/or modified CDS sequence (opt1) from Lassa virus__AHC95554__NP
augagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagcggcgcgacgacggcgaccugaagcggcugcgcgaccucaaccaggccgugaacaaccugguggagcucaagagcacccagcagaaguccguccugcggguggggacccugaacagcgacgaccugcucacccuggccgccgaccuggagaagcucaaguccaaggugacccgcaccgagcggccccugagcuccggcgucuacauggggaaccugagcucccagcagcucgaccagcgccgggcccugcugaacaugaucggcaugacgggcgggaaccagggcgcgcaggccgggcgcgacggcguggugcgggucugggacgugaagaacgccgagcuccugaacaaccaguucgggaccaugccgagccugacccucgccugccugaccaagcagggccagguggaccugaacgacgucgugcaggcgcucacggaccugggccugaucuacaccgccaaguaccccaacaccuccgaccucgaccgccugacccagagccaccccauccugaacaugaucgacacgaagaaguccagccucaacaucagcggguacaacuucucccugggcgccgccgugaaggccggggcgugcaugcuggacggcggcaacaugcucgagaccaucaagaucagcccccaguccgucgacgggauccucaagagcauccugaaggugaagcggucccugggcauguucgugagcgacaccccgggggagcgcaaccccuacgagaacauccuguacaagaucugccuguccggcgacggguggcccuacaucgccagccggaccuccaucgucggccgcgccugggagaacacggugguggaccucgaggccgacggcaagccccagaagccgaacagcggguccagcaacaagucccugcagagcgccggcuuccccgcggggcugaccuacucccagcucaugacccugaaggacgccaugcugcagcuggaccccaacgccaagaccuggauggacaucgagggccggcccgaggacccggucgagguggcccucuaccagcccagcuccgggugcuacauccacuucuuccgcgagcccacggaccugaagcaguucaagcaggacgccaaguacagccacggcaucgacgucaccgaccuguucgcggcccagcccggccucaccuccgccgugaucgaggcccugccgcgcaacauggugaucacgugccaggggagcgaggacaucaagaagcugcucgagagccagggccggaaggacaucaagcugaucgacaucgcccuguccaagaucgacagccgcaaguucgagaacgcggucugggaccaguacaaggaccucugccacaugcacaccggggugguggucgagaagaagaagcggggcgggaaggaggagaucacgccccacugcgcccugauggacugcaucauguucgacgccgccguguccggcggccugaacgcgagcgugcuccgcgccguccugccccgggacaugguguuccgcaccuccacccccaaggugguccuguga

SEQ ID NO: 960 - RNA, 1710 nt, Artificial Sequence
  derived and/or modified CDS sequence (opt1) from Lassa virus__AHC95556__NP
augagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacgcugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcaugacgggcgggaaccagggcacccagaccgggcgggacggcguggugcgcgucugggacgugaagaacgcggagcuccugaacaaccaguucgggaccaugccgucccugacgcucgccugccugaccaagcagggccaggccgaccugaacgacgugguccaggcccucaccgaccugggccugaucuacaccgcgaaguaccccaacgccagcgaccucgaccggcugacgcagucccaccccauccugaacaugaucgacaccaagaaguccagccucaacaucagcggguacaacuucagccugggcgccgccgugaaggccggggcgugcaugcuggacggcggcaacaugcucgagaccaucaaggugagcccccagagcauggacgggauccugaaguccauccugaaggucaagcgcgcccucggcauguucgugagcgacaccccgggggagcggaaccccuacgagaacauccuguacaagaucugccuguccggcgacggguggcccuacaucgccagccgcacguccaucgugggccgggccugggagaacaccgucguggaccucgaggccgacggcaaccccaagaagcugaacagcaacggguccaacaagagccugcaguccgcgggcuucccggccgggcucaccuacagccagcugaugacccugaaggacgccaugcugcagcucgaccccaacgccaagacguggauggacaucgagggccgccccgaggaccccguggaggucgcccuguaccagccgaacuccgggugcuacauccacuucuuccgggagcccaccgaccugaagcaguucaagcaggacgcgaaguacagccacggcaucgacgugaccgaccucuucgccgcccagcccggccugaccuccgccgucaucgaggcccugccccgcaacauggugaucacgugccaggggagcgaggacauccgcaagcuccuggagucccagggccggaaggacaucaagcugaucgacaucgcgcucagcaagaccgacucccgcaaguucgagaacgccgugugggaccagcacaaggaccugugccacaugcacaccggggucgugguggagaagaagaagcggggcgggaaggaggagaucaccccgcacugcgcccugauggacugcaucauguucgacgccgcggucagcggcggccucaacacgcuggugcugcgcgccgugcucccccgggacauggucuuccgcaccagcacccccaagguggugcuguga

SEQ ID NO: 961 - RNA, 1710 nt, Artificial Sequence
  derived and/or modified CDS sequence (opt1) from Lassa virus__AHC95558__NP
augagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagcggcgcgacgacagcgaccugaagcggcugcgcgaccucaaccaggccgugaacaaccugguggagcugaaguccacccagcagaaguccguccuccgggugggcacgcuguccagcgacgaccugcucacccuggccgccgaccuggagaagcucaaguccaaggugauccgcaccgagcggccccugagcuccggggucuacaugggcaaccugagcucccagcagcucgaccagcgccgggcccugcugaacaugaucgggaugaccggcggcaaccagggggcgcaggccggccgcgacgggguggugcgggucugggacgugcgcaacgccgagcuccugaacaaccaguucggcacgaugccgagccugacccucgccugccugaccaagcagggccagguggaccugaacgacgucgugcaggcgcucaccgaccuggggcugaucuacacggccaaguaccccaacaccuccgaccucgaccggcugacccagaaccaccccauccugaacaugaucgacaccaagaaguccagccucaacaucagcggcuacaacuucagccugggggccgccgugaaggccggcgcgugcaugcuggacgggggcaacaugcucgagacgaucaaggucagcccccagagcaucgacggcauccugaaguccauccugaaggugaagcgcacccucgggauguucgugagcgacaccccgggcgagcggaaccccuacgagaacauccuguacaagaucugccuguccggggacggcuggcccuacaucgccagccgcaccuccaucgucgggcgggccugggagaacacggugguggaccucgagaccgaccgcaagagccagggccccaacuccggcaacagcaacaagucccugcagagcgccggguucuccgccggccugaccuacagccagcucaugacccugaaggacgcgaugcugcagcuggacccgaacgccaagacguggauggacaucgaggggcgccccgaggaccccgucgagguggcccucuaccagcccaucuccggcugcuacauccacuucuuccgggagccgaccgaccugaagcaguucaagcaggacgccaaguacagccacgggaucgacaucaccgaccuguucgccgcgcagcccggccucaccuccgccgucaucgaggcccugccccgcaacauggugaucacgugccagggcagcgaggacaucaagaagcugcucgagagccaggggcggaaggacaucaagcugaucgacaucgcccuguccaagaucgacagccgcaaguucgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaacgccagcgugcuccgggcggugcugccgcgggacauggucuuccgcaccuccacccccaagguggugcuguga

SEQ ID NO: 962 - RNA, 1710 nt, Artificial Sequence
  derived and/or modified CDS sequence (opt1) from Lassa virus__AHC95560__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacggcgaccugaagcgccugcgggaccucaaccaggccgugaacaaccugguggagcucaagagcacccagcagaagaacguccugcgcguggggacgcugaacuccgacgaccugcucacccuggccgccgaccuggagaagcucaagagcaaggugacccggaccgagcgcccccuguccagcggcgucuacauggggaaccuguccagccagcagcucgaccagcggcgcgcccugcugaacaugaucggcauguccggcgggaaccagggcacccagguggggcgggacggcgugguccgcgugugggacgugaagaacgcggagcuccugaacaaccaguucgggaccaugccgagccugacccucgccugccugaccaagcagggccaggccgaccugaacgacgucgugcaggcccucacggaccugggccugaucuacaccgcgaaguaccccaacgccuccgaccucgaccggcugacccagagccaccccauccugaacaugaucgacaccaagaaguccagccucaacaucagcggguacaacuucucccugggcgccgccgugaaggccggggcgugcaugcuggacggcggcaacaugcucgagacgaucaaggucagcccccaguccauggacgggauccucaagagcauccugaaggugaagcgcgcccugggcauguucguguccgacaccccgggggagcggaaccccuacgagaacauccuguacaagaucugccugagcggcgacggguggcccuacaucgccucccgcaccagcaucgucggccgggccugggagaacaccgugguggaccucgaggccgacggcaaccccaagaagcugaacuccaacgggagcaacaagucccugcagagcgcgggcuucccggccgggcucacguacucccagcugaugacccugaaggacgccaugcugcagcucgaccccaacgccaagaccuggauggacaucgagggccgccccgaggaccccgucgagguggcccuguaccagccgaacagcgggugcuacauccacuucuuccgggagcccaccgaccugaagcaguucaagcaggacgcgaaguacucccacggcaucgacgucacggaccucuucgccgcccagcccggccugaccagcgccgugaucgaggcccugccccgcaacauggugaucacgugccagggguccgaggacauccgcaagcuccuggagagccagggccggaaggacaucaagcugaucgacaucgcgcucuccaagaccgacagccgcaaguucgagaacgccgucugggaccagcacaaggaccugugccacaugcacacgggggugguggucgagaagaagaagcggggcgggaaggaggagaucaccccgcacugcgcccugauggacugcaucauguucgacgccgcggugagcggcggccucaacacccuggugcugcgcgccguccucccccgggacaugguguuccgcaccuccacgcccaaggugguccuguga

SEQ ID NO: 963 - RNA, 1710 nt, Artificial Sequence
  derived and/or modified CDS sequence (opt1) from Lassa virus__AIT17127__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcaaccagggggugcgggccggcaaggacggggucgugcgcgugugggacgucaagaacgccgagcuccugaacaaccaguucggcaccaugccgucccugacgcucgccugccugaccaagcagggccagguggaccugaacgacgcggugcaggcccucaccgaccuggggcugaucuacaccgccaaguaccccaacacgagcgaccucgaccggcugacccagucccaccccauccugaacaugaucgacaccaagaaguccagccucaacaucuccggcuacaacuucagccugggggccgccgucaaggcgggcgccugcaugcuggacgggggcaacaugcucgagaccaucaaggugagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgccugggagaacacggucguggaccucgaguccgacggcaagccccagaaggcgggcagcaacaacuccaacaagagccugcaguccgccggguucaccgccggccugaccuacagccagcucaugacccugaaggacgccaugcugcagcuggacccgaacacgaagaccuggauggacaucgaggggcggcccgaggaccccguggagaucgcccucuaccagcccuccagcggcugcuacauccacuucuuccgcgagccgaccgaccugaagcaguucaagcaggacgcgaaguacucccacgggaucgacgucaccgaccuguucgccgcccagcccggccucacgagcgccgugaucgacgcccugccccggaacauggugaucacgugccagggcuccgacgacauccgcaagcugcucgagagccaggggcgcaaggacaucaagcugaucgacaucgcgcugaacaagaccgacagccggaaguacgagaacgccgucugggaccaguacaaggaccucugccacaugcacaccggcguggucguggagaagaagaagcgcgggggcaaggaggagaucaccccgcacugcgcccugauggacugcaucauguucgacgccgcgguguccgggggccugaacaccagcguccuccgggccgugcugccccgcgacaugguguuccggaccuccacgccccgcgucgugcuguga

SEQ ID NO: 964 - RNA, 1710 nt, Artificial Sequence
  derived and/or modified CDS sequence (opt1) from Lassa virus__AIT17131__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacgcugagcuccgacgaccugcucguccuggccgccgaccuggagaagcucaagagcaaggugacccggaccgagcgcccccuguccgccgggguguacaugggcaaccugagcucccagcagcucgaccagcggcgcgcgcugcugaacaugaucgggaugagcggcggcaaccagggggcccgggccggccgcgacggggucgugcgggugugggacgucaagaacgccgagcuccugaacaaccaguucggcaccaugccgucccugacgcucgcgugccugaccaagcagggccagguggaccugaacgacgugguccaggcccucaccgaccuggggcugaucuacaccgccaaguaccccaacacgagcgaccucgaccgccugacccagucccaccccauccugaacaugguggacaccaagaaguccagccucaacaucuccggcuacaacuucagccugggggccgccgugaaggcgggcgccugcaugcuggacgggggcaacaugcucgagaccaucaaggucagcccccagacgaucgacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggccugggagaacacgguggucgaccucgaguccgacggcaagccccagaaggcgggcagcaacaacuccaacaagagccugcaguccgccggguucaccgccggccugaccuacagccagcucaugacccugaaggacgccaugcugcagcuggacccgaacgccaagaucuggauggacaucgaggggcgccccgaggaccccguggagaucgcgcucuaccagcccuccagcggcugcuacauccacuucuuccgggagccgacggaccugaagcaguucaagcaggacgccaaguacucccacgggaucgacgugaccgaccuguucgccgcccagcccggccucaccagcgccgucaucgacgcgcugccccgcaacauggugaucacgugccagggcgccgacgacauccgcaagcugcucgagucccaggggcggaaggacaucaagcugaucgacaucgcccugaacaaggccgacagccgcaaguacgagaacgcggucugggaccaguacaaggaccucugccacaugcacaccggcgugguggucgagaagaagaagcgcgggggcaaggaggagaucaccccgcacugcgcccugauggacugcaucauguucgacgccgccgugagcgggggccugaacaccuccgugcuccgggccguccugccccgggacaugguguuccgcaccagcacgccccgggugguccuguga

SEQ ID NO: 965 - RNA, 1710 nt, Artificial Sequence
  derived and/or modified CDS sequence (opt1) from Lassa virus__AIT17139__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggaucguggucgagaagaagaagcggggcgggaaggaggagaucacgccccacugcgcccugauggacugcaucauguucgacgccgccgugagcggcgggcugaacaccuccgugcuccgcgccguccugccgcgggacaugguguuccgcaccaccacgccccgggugguccuguga

SEQ ID NO: 966 - RNA, 1710 nt, Artificial Sequence
  derived and/or modified CDS sequence (opt1) from Lassa virus__AIT17143__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcaacaacggcagcaacaagucccugcagagcgccggguucaccgccggccugaccuacucccagcucaugacgcugaaggacgccaugcugcagcuggacccgaacgcgaagaccuggauggacaucgaggggcgccccgaggaccccguggagaucgcccucuaccagcccagcuccggcugcuacauccacuucuuccgggagccgaccgaccugaagcaguucaagcaggacgccaaguacagccacgggaucgacgugaccgaccuguucgccgcccagcccggccucacguccgcggucaucgacgcccugccccgcaaccuggugaucacgugccagggcagcgacgacauccgcaagcuccuggagucccaggggcggaaggacaucaagcugaucgacaucgcccucagcaagaccgacagccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucuccgggggccucaacaccagcgugcugcgggccgugcugccccgggacauggucuuccgcaccuccacgccccggguggugcucuga

SEQ ID NO: 967 - RNA, 1710 nt, Artificial Sequence
  derived and/or modified CDS sequence (opt1) from Lassa virus__AIT17147__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgagcagcggcgcgcgcugcugaacaugaucgggauguccggcagcaaccagggcgcccaggccgggcgggacggcgucgugcgcgugugggacgucaagaacgccgagcuccugaacaaccaguucgggacgaugccgucccugacccucgcgugccugaccaagcagggccagguggaccugaacgacgccgugcaggcccucaccgaccuggggcugaucuacacggucaaguaccccaacaccagcgaccucgaccggcugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgacaccccgggggagcgcaaccccuacgagaacauccuguacaagaucugccugagcggcgacggguggcccuacaucgccucccggaccagcaucacgggccgcgccugggagaacaccgugguggaccucgaguccgacgggaagccccagaaggcggacagcaacuccagcaacaagucccugcagagcgccggcuucaccgccggccugaccuacucccagcucaugacgcugaaggacgccaugcugcagcuggacccgaacgccaagaccuggauggacaucgaggggcggcccgaggaccccgucgagguggcgcucuaccagcccagcuccggcugcuacauccacuucuuccgcgagccgaccgaccugaagcaguucaagcaggacgccaaguacagccacgggaucgacgugaccgaccuguucgccgcccagcccggccucacguccgccgucaucgacgcgcugccccggaacauggugaucacgugccaggggagcgacgacauccgcaagcugcucgagagccagggccgcaaggacaucaagcugaucgacaucgcccuguccaagaccgacagccggaaguacgagaacgccgucugggaccaguacaaggaccucugccacaugcacaccggcgugguggucgagaagaagaagcgcgggggcaaggaggagaucaccccgcacugcgcccugauggacugcaucauguucgacgcggccguguccgggggccugaacaccagcgugcuccgggccguccugccccgcgacaugguguuccggaccuccacgccccgcgugguccuguga

SEQ ID NO: 968 - RNA, 1710 nt, Artificial Sequence
  derived and/or modified CDS sequence (opt1) from Lassa virus__AIT17151__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacguggugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagcugcagaaggcgggcagcaacaacuccaacaagagccugcaguccgccggguucaccgccggccucaccuacagccagcugaugacgcugaaggacgccaugcugcagcucgaccccaacgccaagaccuggauggacaucgaggggcgcccggaggaccccguggagaucgcgcuguaccagcccuccagcggcugcuacauccacuucuuccgggagcccaccgaccugaagcaguucaagcaggacgccaaguacucccacgggaucgacgucaccgaccucuucgccgcccagccgggccugacgagcgccgugaucgacgcgcugccccgcaacauggugaucacgugccagggcuccgacgacauccgcaagcuccuggagagccaggggcggaaggacaucaagcugaucgacaucgcccucaacaagaccgacagccgcaaguacgagaacgccgucugggaccaguacaaggaccugugccacaugcacaccggcguggucguggagaagaagaagaagggcgggaaggaggagaucacgccccacugcgcccugauggacugcaucauguucgacgcggccguguccgggggccucaacaccagcguccugcgggccgugcugccccgcgacaugguguuccggaccuccaccccgcgcgucgugcucuga

SEQ ID NO: 969 - RNA, 1710 nt, Artificial Sequence
  derived and/or modified CDS sequence (opt1) from Lassa virus__AIT17155__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgagcugcucgugcuggccgccgaccuggagaagcucaaguccaaggugauccggaccgagcgcccccugagcgccggggucuacaugggcaaccuguccagccagcagcucgaccagcggcgcgcgcugcuguccaugaucgggaugagcggcggcaaccagggggcccggaccggccgcgacgggguggugcgggucugggacgugaagaacgccgagcuccugaacaaccaguucggcaccaugccgucccugacccucgccugccugaccaagcagggccagguggaccugaacgacgcgguccaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggggccgccgugaaggcgggcgccugcaugcuggacgggggcaacaugcucgagacgaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgugguggaccucgaguccgacggcaagccccagaaggcgggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccgucgagaucgcgcucuaccagcccuccagcggcugcuacauccacuucuuccgggagccgaccgaccugaagcaguucaagcaggacgccaaguacucccacgggaucgacgugaccgaccuguucgccgcccagcccggccucacgagcgccgugaucgacgcgcugccccgcaacauggucaucacgugccagggcuccgacgacauccgcaagcugcucgagagccaggggcggaaggacaucaagcugaucgacaucgcccugagcaagaucgacucccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgcggccgucagcgggggccugaacucccucgugcugcgggccgugcugccgcgggacauggucuuccgcaccagcacgccccggguggugcucuga

SEQ ID NO: 970 - RNA, 1710 nt, Artificial Sequence
  derived and/or modified CDS sequence (opt1) from Lassa virus__AIT17161__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggaccgggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccguggucgaccucgaguccgacgggaagccccagaaggcgggcagcaacuccagcaacaagucccugcagagcgccggccugaccgccgggcucacguacucccagcugaugacccugaaggacgccaugcugcagcucgacccgaacgccaagaccuggauggacaucgagggccgccccgaggaccccguggagaucgcgcuguaccagcccagcuccgggugcuacauccacuucuuccgggagccgaccgaccugaagcaguucaagcaggacgccaaguacagccacggcaucgacgugacggaccucuucgccgcccagcccgggcugaccuccgccgucaucgacgcgcugccccgcaaccucgugaucacgugccagggcagcgacgacauccgcaagcugcuggagagccagggccggaaggacaucaagcucaucgacaucgcccuguccaagaccgacagccgcaaguacgagaacgccgugugggaccaguacaaggaccugugccacaugcacaccgggaucgucguggagaagaagaagcggggcgggaaggaggagaucacgccccacugcgcccucauggacugcaucauguucgacgcggccgucuccggcgggcugaacgccagcgugcugcgcgccgugcucccgcgggacauggucuuccgcaccuccacgccccggguggugcuguga

SEQ ID NO: 971 - RNA, 1710 nt, Artificial Sequence
  derived and/or modified CDS sequence (opt1) from Lassa virus__AIT17165__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgaggugaacaacgugcagcgccucaugcggaaggagcgccgggacgacaacgaccugaagcgccugcgggaccucaaccaggccgucaacaaccugguggagcugaaguccacccagcagaaguccauccuccgcgugggcacccugaccuccgacgaccugcucauccuggccgccgaccuggagaagcucaagagcaaggucacccggaccgagcgcccccuguccgccgggguguacaugggcaaccugagcucccagcagcucgaccagcggcgcgcgcugcugaacaugaucgggaugagcaacggcaaccagggcacgcgggccgggcgcgacggcgugguccgggugugggacgugaagaacgccgagcuccugaacaaccaguucgggaccaugccgucccugacccucgccugccugaccaagcagggccaggucgaccugaacgacguggugcaggcgcucacggaccuggggcugaucuacaccgccaaguaccccaacaccagcgaccucgaccgccugacccagucccaccccauccugaacaugaucgacacgaagaaguccagccucaacaucagcggcuacaacuucagccugggcgccgccgucaaggccggggcgugcaugcuggacggcgggaacaugcucgagaccaucaaggugagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccgucguggaccucgaguccgacgggaagccccagaaggccgacagcuccaacagcaacaagucccugcagagcgcgggcuucaccgccggccugacguacucccagcucaugacccugaaggacgccaugcugcagcuggacccgaacgccaagaccuggauggacaucgaggggcgccccgaggaccccguggaggucgcccucuaccagcccagcuccggcugcuacauccacuucuuccgggagccgaccgaccugaagcaguucaagcaggacgcgaaguacagccacgggaucgacgugacggaccuguucgccgcccagcccggccucaccuccgccgugaucgacgcccugccccgcaacauggucaucacgugccaggggagcgacgacauccgcaagcugcucgagucccagggccggaaggacaucaagcugaucgacaucgcgcugagcaaggccgacagccgcaaguacgagaacgccgugugggaccagcacaaggaccucugccacaugcacaccggcgucgugguggagaagaagaagcgcgggggcaaggaggagaucaccccgcacugcgcccugauggacugcaucauguacgacgcggccgucuccgggggccugaacaccagcgugcuccgggccgugcugccccgggacauggucuuccgcaccuccacgccccggguggugcuguga

SEQ ID NO: 972 - RNA, 1710 nt, Artificial Sequence
  derived and/or modified CDS sequence (opt1) from Lassa virus__AIT17169__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcuccggcaaccagcgggcccaggccggccgcgacggggugguccgggugugggacgugaagaacgucgagcuccugaacaaccaguucggcaccaugccgagccugacgcucgccugccugaccaagcagggccagguggaccugaacgacgcggugcaggcccucaccgaccuggggcugaucuacaccgccaaguaccccaacacguccgaccucgaccgccugacccagagccaccccauccugaacaugaucgacaccaagaaguccagccucaacaucagcggguacaacuucucccugggcgccgccgucaaggcgggcgccugcaugcuggacgggggcaacaugcucgagaccaucaaggugagcccccagacgauggacgggauccugaaguccauccugaaggugaagaaggcccucggcauguucaucagcgacaccccgggcgagcggaaccccuacgagaacauccuguacaagaucugccuguccggggacggcuggcccuacaucgccagccgcaccuccaucaccgggcgggccugggagaacacggucguggaccucgagagcgacggcaagccccagaaggcgggguccaacaacagcaacaagucccugcagagcgugggcuucaccgccggccugaccuacucccagcucaugacccugaaggacgccaugcugcagcuggacccgaacgccaagacguggauggacaucgaggggcgccccgaggaccccgucgagaucgcccucuaccagcccagcuccggcugcuacauccacuucuuccgggagccgaccgaccugaagcaguucaagcaggacgcgaaguacagccacgggaucgacgugaccgaccuguucgccgcccagcccggccucaccuccgccgugaucgacgcccugccccgcaacauggucaucacgugccaggggagcgacgacauccgcaagcugcucgagagccagggccggaaggacaucaagcugaucgacaucgcgcuguccaagaccgacagccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgccgcggucuccgggggccugaacaccagcgugcuccgggccgugcugccgcgggacauggucuuccgcaccuccacgccccggguggugcuguga

SEQ ID NO: 973 - RNA, 1710 nt, Artificial Sequence
  derived and/or modified CDS sequence (opt1) from Lassa virus__AIT17173__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgggacauggucuuccgcaccagcacgccccggguggugcuguga

SEQ ID NO: 974 - RNA, 1710 nt, Artificial Sequence
  derived and/or modified CDS sequence (opt1) from Lassa virus__AIT17177__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucgugcuggccgccgaccuggagaagcucaaguccaaggugauccggaccgagcgcccccugagcgccgggaucuacaugggcaaccuguccagccagcagcucgaccagcggcgcgcgcugcugaacaugaucgggauguccggcggcaaccagggggcccgggccggccgcgacggggucgugcgggugugggacgucaagaacgccgaccuccugaacaaccaguucggcaccaugccgagccugacgcucgcgugccugaccaagcagggccagguggaccugaacgacgugguccaggcccucaccgaccuggggcugaucuacaccgccaaguaccccaacacguccgaccucgaccgccugacccagagccaccccauccugaagaugaucgacgccaacaaguccagccucaacaucagcggcuacaacuucucccugggggccgcggugaaggccggcgccugcaugcuggacgggggcaacaugcucgagaccaucaaggugagcccccagaccauggacggcauccugaaguccauccugaaggucaagaagucccucgggauguucaucagcgacacgccgggcgagcggaaccccuacgagaacauccuguacaagaucugccugagcggggacggcuggcccuacaucgccucccgcaccagcaucaucgggcgggccugggagaacaccgugguggaccucgaguccgacggcaagccccagaagaccggcagcaacaacuccagcaagucccugcagagcgcgggguucgccgccggccugacguacucccagcucaugacccugaaggacgccaugcugcagcuggacccgaacgccaagaccuggauggacaucgaggggcgccccgaggaccccgucgagaucgcgcucuaccagcccagcuccggcugcuacauccacuucuuccgggagccgaccgaccugaagcaguucaagcaggacgccaaguacagccacgggaucgacgugacggaccuguucgccgcccagcccggccucaccuccgccgugaucgaggcgcugccccgcaacauggucaucacgugccagggcagcgacgacauccgcaagcugcucgagagccaggggcggaaggacaucaagcugaucgacaucgcccuguccaagaccgacagccgcaaguacgagaacgccgugugggaccaguacaaggaccucugccacaugcacaccggcaucgucguggagaagaagaagcgcgggggcaaggaggagaucacgccccacugcgcccugauggacugcaucauguucgacgcggccguguccgggggccugaacacccucguccugcgggccgugcugccgcgggacaugguguuccgcaccagcacccccaaggucgugcucuga

SEQ ID NO: 975 - RNA, 1710 nt, Artificial Sequence
  derived and/or modified CDS sequence (opt1) from Lassa virus__AIT17181__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacaacgaccugaagcgccugcgggaccucaaccaggccgugaacaaccugguggagcucaagagcacccagcagaaguccguccugcgcgugggcacccugaccagcgacgaccugcucgugcuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcauccaggggacccggacgggccgcgacggggugguccgggugugggacgugaagaacgccgaccuccugaacaaccaguucggcaccaugccgagccugacccucgccugccugaccaagcaggggcaggucgaccugaacgacguggugcaggcccucacggaccugggccugaucuacaccgcgaaguaccccaacgccuccgaccucgaccgccugacccagagccaccccauccugaacaugaucgacaccaagaaguccagccucaacaucagcggcuacaacuucucccugggggccgccgucaaggccggcgcgugcaugcuggacgggggcaacaugcucgagacgaucaaggugagcccccagaccauggacggcauccugaaguccauccugaaggugaagaagacccucgggauguucaucagcgacaccccgggcgagcggaaccccuacgagaacauccuguacaagaucugccuguccggggacggcuggcccuacaucgccagccgcacguccaucaccgggcgggccugggagaacaccgucguggaccucgagagcgacggcaagccccagaaggccggcuccaacaacagcaacaagucccugcagagcgccggguucgcggccggccugaccuacucccagcucaugacgcugaaggacgccaugcugcagcuggacccgaacgccaagaccuggauggacaucgaggggcgccccgaggaccccguggagaucgcccucuaccagcccagcuccggcugcuacauccacuucuuccgggagccgaccgaccugaagcaguucaagcaggacgcgaaguacagccacgggaucgacgucaccgaccuguucgccgcccagcccggccucacguccgccgugaucgaggcccugccccgcaacauggucaucacgugccagggcagcgacgacaucaagaagcugcucgagucccaggggcgcaaggacaucaagcugaucgacaucgcgcugagcaagaccgacagccggaaguacgagaacgccgugugggaccaguacaaggaccucugccacaugcacaccggcguggucguggagaagaagaagcgcgggggcaaggaggagaucaccccgcacugcgcccugauggacugcaucauguucgacgccgcgguguccgggggccugaacacccucguccugcgggccgugcugccccgcgacaugguguuccggaccagcacgccccgcgucgugcucuga

SEQ ID NO: 976 - RNA, 1710 nt, Artificial Sequence
  derived and/or modified CDS sequence (opt1) from Lassa virus__AIT17185__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcucaagagcacccagcagaaguccgugcugcgcgucgggacccugaccagcgacgaccugcucauccuggccgccgaccuggagaagcucaaguccaaggugacccggaccgagcgcccccugagcgccggcguguacauggggaaccuguccagccagcagcucgaccagcggcgcgcgcugcugaacaugaucggcauguccggcgggaaccggggcgcccgcacggggaaggacggcgucgugcggaucugggacgugaagaacgccgaccuccugaacaaccaguucgggaccaugccgagccugacccucgccugccugaccaagcagggccaggucgaccugaacgacguggugcaggcgcucacggaccugggccugaucuacaccgccaaguaccccaacaccuccgaccucgaccgccugacccagagccaccccauccugaacaugaucgacacgaacaaguccagccucaacaucagcggguacaacuucucccugggcgccgccgucaaggccggggcgugcaugcuggacggcggcaacaugcucgagaccaucaaggugagcccccagaccauggacgggauccugaaguccauccugaaggugaagaagucccucggcauguucaucagcgacaccccgggggagcggaaccccuacgagaacauccuguacaagaucugccugagcggcgacggguggcccuacaucgccucccgcacgagcaucaccggccgggccugggagaacaccgucguggaccucgaguccgacgagaagccccagaaggccggcagcaacaacuccaacaagagccugcaguccaccggguucacggccggccugaccuacagccagcucaugacccugaaggacgcgaugcugcagcuggacccgaacgccaagaccuggauggacaucgaggggcgccccgaggaccccguggagaucgcccucuaccagcccuccagcggcugcuacauccacuucuuccgggagccgacggaccugaagcaguucaagcaggacgccaaguacucccacgggaucgacgucaccgaccuguucgccgcgcagcccggccucaccagcgccgugaucgacacccugccccgcaacauggugaucacgugccagggcuccgacgacauccgcaagcugcucgagagccaggggcggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucacgccccacugcgcccugauggacugcaucauguucgacgcggccgugagcgggggccugaacgccuccguccuccgggccgugcugccgcgggacaugguguuccgcaccagcacgccccgggucgugcuguga

SEQ ID NO: 977 - RNA, 1710 nt, Artificial Sequence
  derived and/or modified CDS sequence (opt1) from Lassa virus__AIT17189__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggaccggccgcgacggggucgugcgggugugggacgucaagaacgccgagcuccugaacaaccaguucggcaccaugccgucccugacccucgccugccugaccaagcagggccagguggaccugaacgacgugguccaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggugagcccccagaccaucgacggcauccucaagagcauccugaaggucaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgugguggaccucgaguccgacggcaagccccagaaggccggcagcaacaacuccaacaagagccugcaguccgcgggguucaccgccggccugacguacagccagcucaugacccugaaggacgccaugcugcagcuggacccgaacgccaagaccuggauggacaucgaggggcgccccgaggaccccgucgagaucgcccucuaccagcccuccagcggcugcuacauccacuucuuccgggagccgaccgaccugaagcaguucaagcaggacgcgaaguacucccacgggaucgacgugacggaccuguucgccgcccagcccggccucaccagcgccgugaucgacgcccugccccgcaacauggucaucacgugccagggcuccgacgacauccgcaagcugcucgagagccaggggcggaaggacaucaagcugaucgacaucgcgcugagcaagaccgacucccgcaaguacgagaacgccgugugggaccaguacaaggaccucugccacaugcacaccggcgucgugguggagaagaagaagcgcgggggcaaggaggagaucacgccccacugcgcccugauggacugcaucauguucgacgccgcggucagcgggggccugaacucccucgugcugcgggccgugcugccgcgggacauggucuuccgcaccagcacgccccggguggugcucuga

SEQ ID NO: 978 - RNA, 1710 nt, Artificial Sequence
  derived and/or modified CDS sequence (opt1) from Lassa virus__AIT17193__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggaccggccgcgacggggucgugcgggugugggacgucaagaacgccgagcuccugaacaaccaguucggcaccaugccgucccugacccucgccugccugaccaagcagggccagguggaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgucaaggcgggcgccugcaugcuggacgggggcaacaugcucgagaccaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgucguggaccucgaguccgacggcaagccccagaaggcgggcaacaacaacagcaacaagucccugcagagcgccggguucaccgccggccugacguacucccagcucaugacccugaaggacgccaugcugcagcuggacccgaacgccaagaccuggauggacaucgaggggcgccccgaggaccccguggagaucgcgcucuaccagcccagcuccggcugcuacauccacuucuuccgggagccgaccgaccugaagcaguucaagcaggacgccaaguacagccacgggaucgacgucacggaccuguucgccgcccagcccggccucaccuccgccgugaucgacgcgcugccccgcaacauggugaucacgugccagggcagcgacgacauccgcaagcugcucgagucccaggggcggaaggacaucaagcugaucgacaucgcccugagcaagaccgacagccgcaaguacgagaacgccgucugggaccaguacaaggaccucugccacaugcacaccggcguggucguggagaagaagaagcgcgggggcaaggaggagaucacgccccacugcgcccugauggacugcaucauguucgacgcggccguguccgggggccugaacagccucguccugcgggccgugcugccgcgggacaugguguuccgcaccuccacgccccgggucgugcucuga

SEQ ID NO: 979 - RNA, 1710 nt, Artificial Sequence
  derived and/or modified CDS sequence (opt1) from Lassa virus__AIT17197__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccugucccuccagcagcuggaccagcggcgcgcgcugcucaacaugaucgggaugagcggcuccaaccagggcgugcgggccgggcgcgacggcgucgugcgggugugggacgucaagaacgccgagcugcugaacaaccaguucgggaccaugccgagccucacgcuggccugccugaccaagcagggccagguggaccucaacgacgcggugcaggcccugaccgaccuggggcucaucuacaccgccaaguaccccaacacguccgaccuggaccgccugacccagagccaccccauccucaacaugaucgacaccaagaaguccagccugaacaucagcggcuacaacuucucccugggcgccgccgucaaggcgggggccugcaugcucgacggcgggaacaugcuggagaccaucaaggugagcccccagacgauggacggcauccugaaguccauccucaaggugaagaaggcccugggcauguucaucagcgacaccccgggggagcggaaccccuacgagaacauccuguacaagaucugccucuccggcgacggguggcccuacaucgccagccgcaccuccaucaccggccgggccugggagaacacggucguggaccuggagagcgacgggaagccccagaaggcgggcuccaacggcagcaacaagucccugcagagcgccggguucaccgccggccucaccuacucccagcugaugacccugaaggacgccaugcugcagcucgacccgaacgccaagacguggauggacaucgaggggcgccccgaggaccccguggagaucgcgcuguaccagcccagcuccggcugcuacauccacuucuuccgggagccgaccgaccugaagcaguucaagcaggacgccaaguacagccacgggaucgacgucaccgaccucuucgccgcccagcccggccugaccuccgccgugaucgacgcgcugccccgcaacauggugaucacgugccagggcagcgacgacauccgcaagcuccuggagucccaggggcggaaggacaucaagcugaucgacaucgcccucagcaagaccgacagccgcaaguacgagaacgccgucugggaccaguacaaggaccugugccacaugcacaccggcaucguggucgagaagaagaagcgcgggggcaaggaggagaucacgccccacugcgcccugauggacugcaucauguucgacgcggccguguccgggggccucaacaccagcgugcugcgggccguccugccgcgggacaugguguuccgcaccuccacgccccgggugguccucuga

SEQ ID NO: 980 - RNA, 1710 nt, Artificial Sequence
  derived and/or modified CDS sequence (opt1) from Lassa virus__AIT17201__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacaucaagaagcuguucgagagccaggggcgcaaggacaucaagcucaucgacaucgcccugagcaagaccgacucccggaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgcgacauggucuuccggaccagcacgccccgcguggugcuguga

SEQ ID NO: 981 - RNA, 1710 nt, Artificial Sequence
  derived and/or modified CDS sequence (opt1) from Lassa virus__AIT17205__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggaaggcgcugcugaacaugaucgggauguccggcagcaaccagggcgcccgcaucgggcgggacggcgugguccgcgugugggacgugaagaacgccgagcuccugaacaaccaguucgggacgaugccgucccugacccucgccugccugaccaagcagggccaggucgaccugaacgacgcggugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggucagcccccagaccauggacggcauccucaagagcauccugaaggugaagaaggcccugggcauguucaucuccgacaccccgggggagcgcaaccccuacgagaacauccuguacaagaucugccugagcggcgacggguggcccuacaucgccucccggaccagcaucacgggccgcgccugggagaacaccguggucgaccucgaguccgacgggaagccccagaaggcgggcagcaacuccagcaacaagucccugcagagcgccggccugaccgccgggcucaccuacucccagcugaugacgcugaaggacgccaugcugcagcucgacccgaacgccaagaccuggauggacaucgagggccggcccgaggaccccguggagaucgcgcuguaccagcccagcuccgggugcuacauccacuucuuccgcgagccgaccgaccugaagcaguucaagcaggacgccaaguacagccacggcaucgacgugaccgaccucuucgccgcccagcccgggcugacguccgccgucaucgacgcgcugccccggaaccucgugaucacgugccagggcagcgacgacauccgcaagcugcuggagagccagggccgcaaggacaucaagcucaucgacaucgcccuguccaagaccgacagccggaaguacgagaacgccgugugggaccaguacaaggaccugugccacaugcacaccgggaucgucguggagaagaagaagcgcggcgggaaggaggagaucaccccgcacugcgcccucauggacugcaucauguucgacgcggccgucuccggcgggcugaacgccagcgugcugcgggccgugcucccccgcgacauggucuuccggaccuccacgccccgcguggugcuguga

SEQ ID NO: 982 - RNA, 1710 nt, Artificial Sequence
  derived and/or modified CDS sequence (opt1) from Lassa virus__AIT17209__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacguggugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagcugcagaagaccggcagcaacaacuccaacaagagccugcaguccgcgggguucaccgccggccucacguacagccagcugaugacccugaaggacgccaugcugcagcucgaccccaacgccaagaucuggauggacaucgaggggcgcccggaggaccccguggagaucgcccuguaccagcccuccagcggcugcuacauccacuucuuccgggagcccaccgaccugaagcaguucaagcaggacgcgaaguacucccacgggaucgacgucaccgaccucuucgccgcccagccgggccugacgagcgccgugaucgacgcccugccccgcaacauggugaucacgugccagggcuccgacgacauccgcaagcuccuggagagccaggggcggaaggacaucaagcugaucgacaucgcgcucaacaagaccgacagccgcaaguacgagaacgccgucugggaccaguacaaggaccugugccacaugcacaccggcguggucguggagaagaagaagaagggcgggaaggaggagaucacgccccacugcgcccugauggacugcaucauguucgacgccgcgguguccgggggccucaacaccagcguccugcgggccgugcugccccgcgacaugguguuccggaccuccaccccgcgcgucgugcucuga

SEQ ID NO: 983 - RNA, 1710 nt, Artificial Sequence
  derived and/or modified CDS sequence (opt1) from Lassa virus__AIT17211__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccaggccggccgggacggggugguccgcgugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccggcugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaaguccauccugaaggugaagaaggcccucgggauguucaucagcgacaccccgggcgagcgcaaccccuacgagaacauccuguacaagaucugccuguccggggacggcuggcccuacaucgccagccggaccuccaucacggggcgcgcgugggagaacaccguggucgaccucgagagcgacggcaagccccagaaggccaacuccaacagcuccaacaagagccugcaguccgccggcuucaccgccgggcugaccuacagccagcucaugacgcugaaggacgccaugcugcagcuggacccgaacgcgaagaccuggauggacaucgagggccggcccgaggaccccguggagaucgcccucuaccagcccuccagcgggugcuacauccacuucuuccgcgagccgaccgaccugaagcaguucaagcaggacgccaaguacucccacggcaucgacgugaccgaccuguucgccgcccagcccgggcucacgagcgcggucaucgacgcccugccccggaacauggugaucacgugccagggcuccgacgacauccgcaagcugcucgagagccagggccgcaaggacaucaagcugaucgacaucgcccugagcaagaccgacucccggaaguacgagaacgccgugugggaccaguacaaggaccucugccacaugcacaccgggaucgucguggagaagaagaagcgcggcgggaaggaggagaucaccccgcacugcgcgcugauggacugcaucauguucgacgccgccgucagcggcgggcugaacaccuccgugcuccgggccgugcugccccgcgacauggucuuccggaccagcacgccccgcguggugcuguga

SEQ ID NO: 984 - RNA, 1710 nt, Artificial Sequence
  derived and/or modified CDS sequence (opt1) from Lassa virus__AIT17213__NP
augagcgccuccaaggagaucaagagcuuccuguggacccagucccuccgccgggagcuggccggcuacugcagcaacaucaagcuccagguggucaaggacgcgcaggcccugcugcacgggcuggacuucuccgaggugagcaacgugcagcgccucaugcggaaggagcgccgggacgacaacgaccugaagcgccugcgggaccucaaccaggccgucaacaaccugguggagcugaaguccacccagcagaaguccgugcuccgcgucggcacccugaccagcgacgaccugcucauccuggccgccgaccuggagaagcucaagagcaaggugauccggaccgagcgcccccuguccgcggggguguacaugggcaaccugagcucccagcagcucgaccagcggcgcgcccugcugaacaugaucgggaugagcggcuccaaccagggcguccgggccgggcgcgacggcguggugcgggucugggacgugaagaacgccgagcuccugaacaaccaguucgggaccaugccgagccugacgcucgcgugccugaccaagcagggccagguggaccugaacgacgccguccaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggcgccgcggugaaggccggggccugcaugcuggacggcgggaacaugcucgagaccaucaaggugagcccccagacgauggacggcauccugaaguccauccugaaggucaagaaggcccucggcauguucaucagcgacaccccgggggagcggaaccccuacgagaacauccuguacaagaucugccuguccggcgacggguggcccuacaucgccagccgcaccuccaucaccggccgggcgugggagaacacggugguggaccucgagagcgacgggaagccccagaaggccggcuccaacggcagcaacaagucccugcagagcgccggguucaccgccggccugaccuacucccagcucaugacccugaaggacgccaugcugcagcuggacccgaacgcgaagacguggauggacaucgaggggcgccccgaggaccccgucgagaucgcccucuaccagcccagcuccggcugcuacauccacuucuuccgggagccgaccgaccugaagcaguucaagcaggacgccaaguacagccacgggaucgacgugaccgaccuguucgccgcccagcccggccucaccuccgcggugaucgacgcccugccccgcaacauggucaucacgugccagggcagcgacgacauccgcaagcugcucgagucccaggggcggaaggacaucaagcugaucgacaucgcccugagcaagaccgacagccgcaaguacgagaacgccgugugggaccaguacaaggaccucugccacaugcacaccggcaucgucguggagaagaagaagcgcgggggcaaggaggagaucacgccccacugcgcgcugauggacugcaucauguucgacgccgccguguccgggggccugaacaccagcguccuccgggccgugcugccgcgggacaugguguuccgcaccuccacgccccgggucgugcuguga

SEQ ID NO: 985 - RNA, 1710 nt, Artificial Sequence
  derived and/or modified CDS sequence (opt1) from Lassa virus__AIT17217__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcuccggcgugcagggcgcccgggccgggcgcgacggcgucgugcgggugugggacgucaagaacgccgagcuccugaacaaccaguucgggacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggugagcccccagaccauggacggcauccugaaguccauccugaaggucaagaaggcccucggcauguucaucagcgagaccccgggggagcggaaccccuacgagaacauccuguacaagaucugccuguccggcgacggguggcccuacaucgccagccgcaccuccaucacgggccgggccugggagaacaccgugguggaccucgagagcgacgggaagccccagaaggcgggcuccaacaacagcaacaagucccugcagagcaccggcuucgccgccgggcugaccuacucccagcucaugacgcugaaggacgccaugcugcagcuggacccgaacgccaagaccuggauggacaucgagggccgccccgaggaccccgucgagguggcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgucaucgacgcgcugccccgcaacauggugaucacgugccagggcagcgacgacaucaagaagcugcucgagagccagggccgcaaggacaucaagcugaucgacaucgcccuguccaagaccgacagccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccguguccggcgggcugaacaccagcgugcuccgggccguccugccccgcgacaugguguuccggaccuccacgccccgcgugguccuguga

SEQ ID NO: 986 - RNA, 1710 nt, Artificial Sequence
  derived and/or modified CDS sequence (opt1) from Lassa virus__AIT17225__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcugaacaugaucgggauguccggcggcaaccagggggcccgggccggcaacgacgggguggugcgcgucugggacgugaagaacgccgaccuccugaacaaccaguucggcacgaugccgagccugacccucgcgugccugaccaagcagggccagguggaccugaacgacgucgugcaggcccucaccgaccuggggcugaucuacacggccaaguaccccaacaccuccgaccucgaccggcugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggucagcccccagaccauggacggcauccugaaguccauccugaaggugaagaaggcccucgggauguucaucagcgacaccccgggcgagcgcaaccccuacgagaacauccuguacaagaucugccuguccggggacggcuggcccuacaucgccagccggaccuccaucacggggcgcgccugggagaacaccguggucgaccucgagagcgacggcaagccccagaagaccggcaacaacuccagcaacaagucccugcagagcgcgggguucaccgccggccugacguacucccagcucaugacccugaaggacgccaugcugcagcuggacccgaacgccaagaccuggauggacaucgaggggcggcccgaggaccccguggagguggcccucuaccagcccagcuccggcugcuacauccacuucuuccgcgagccgaccgaccugaagcaguucaagcaggacgcgaaguacagccacgggaucgacgucacggaccuguucgccgcccagcccggccucaccuccgccgugaucgaggcccugccccggaacauggucaucacgugccagggcagcgacgacauccgcaagcugcucgagucccaggggcgcaaggacaucaagcugaucgacaucgcgcugagcaagaucgacagccggaaguacgagaacgccgugugggaccaguacaaggaccucugccacaugcacaccggcguggucguggagaagaagaagcgcgggggcaaggaggagaucacgccccacugcgcccugauggacugcaucauguucgacgccgcgguguccgggggccugaacacccucguccugcgggccgugcugccgcgcgacaugguguuccggaccagcacccccaaggucgugcucuga

SEQ ID NO: 987 - RNA, 1710 nt, Artificial Sequence
  derived and/or modified CDS sequence (opt1) from Lassa virus__AIT17229__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcuguccaugaucgggaugagcggcggcaaccaggggacccgggccggccgcgacggggucgugcgggugugggacgucaagaacgccgagcuccugaacaaccaguucggcaccaugccgucccugacccucgccugccugaccaagcagggccagguggaccugaacgacgcggugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggggccgccgucaaggcgggcgccugcaugcuggacgggggcaacaugcucgagacgaucaaggugagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccgucguggaccucgaguccgacggcaagccccagaaggcgggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccguggagaucgcgcucuaccagcccuccagcggcugcuacauccacuucuuccgggagccgaccgaccugaagcaguucaagcaggacgccaaguacucccacgggaucgacgucaccgaccuguucgccgcccagcccggccucacgagcgccgugaucgacgcgcugccccgcaacauggugaucacgugccagggcuccgacgacauccgcaagcugcucgagagccaggggcggaaggacaucaagcugaucgacaucgcccugagcaaggccgacucccgcaaguacgagaacgccgucugggaccaguacaaggaccucugccacaugcacaccggcguggucguggagaagaagaagcgcgggggcaaggaggagaucacgccccacugcgcgcugauggacugcaucauguucgacgccgccgugagcgggggccugaacaccuccguccuccgggccgugcugccgcgggacaugguguuccgcaccagcacgccccgggucgugcuguga

SEQ ID NO: 988 - RNA, 1710 nt, Artificial Sequence
  derived and/or modified CDS sequence (opt1) from Lassa virus__AIT17233__NP
augagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaaggagcgccgggacgacaacgaccugaagcgccugcgggaccucaaccaggccgugaacaaccugguggagcucaagagcacccagcagaaguccauccugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagggggcccaggccggccgggacgggguggugcgcgucugggacgugaagaacgccgagcuccugaacaaccaguucggcacgaugccgucccugacccucgcgugccugaccaagcagggccagguggaccugaacgacgccguccaggcccucaccgaccuggggcugaucuacacggccaaguaccccaacaccagcgaccucgaccggcugacccagucccaccccauccugaacaugaucgacaccaagaaguccagccucaacaucagcggcuacaacuucagccugggggccgcggugaaggccggcgccugcaugcuggacgggggcaacaugcucgagacgaucaaggugagcccccagaccauggacggcauccucaagagcauccugaaggucaagaaggcccuggggauguucaucuccgacaccccgggcgagcgcaaccccuacgagaacauccuguacaagaucugccugagcggggacggcuggcccuacaucgccucccggaccagcaucacggggcgcgcgugggagaacaccgugguggaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcggcccgaggaccccgucgagguggcccucuaccagcccuccagcggcugcuacauccacuucuuccgcgagccgaccgaccugaagcaguucaagcaggacgccaaguacucccacgggaucgacgugaccgaccuguucgccgcccagcccggccucacgagcgcggucaucgacgcccugccccggaacauggugaucacgugccagggcuccgacgacauccgcaagcugcucgagagccaggggcgcaaggacaucaagcugaucgacaucgcccugagcaagaccgacucccggaaguacgagaacgccgucugggaccaguacaaggaccucugccacaugcacaccggcgugguggucgagaagaagaagcgcgggggcaaggaggagaucaccccgcacugcgcgcugauggacugcaucauguucgacgccgccgugagcgggggccugaacaccuccgugcuccgggccguccugccccgcgacaugguguuccggaccagcacgccccgcgugguccuguga

SEQ ID NO: 989 - RNA, 1710 nt, Artificial Sequence
  derived and/or modified CDS sequence (opt1) from Lassa virus__AIT17237__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagacgaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagguggcccucuaccagcccuccagcggcugcuacauccacuucuuccgggagccgaccgaccugaagcaguucaagcaggacgccaaguacucccacgggaucgacgucaccgaccuguucgccgcccagcccggccucacgagcgcggugaucgacgcccugccccgcaacauggugaucacgugccagggcuccgacgacauccgcaagcugcucgagagccaggggcggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucaccccgcacugcgcgcugauggacugcaucauguucgacgccgccgugagcgggggccugaacaccuccguccuccgggccgugcugccccgggacaugguguuccgcaccagcacgccccgggucgugcuguga

SEQ ID NO: 990 - RNA, 1710 nt, Artificial Sequence
  derived and/or modified CDS sequence (opt1) from Lassa virus__AIT17241__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagacgaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccggcagcaacaacuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcccagcccggccucacgagcgcggucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcgucguggucgagaagaagaagcgcgggggcaaggaggagaucaccccgcacugcgcgcucauggacugcaucauguucgacgccgccgugagcgggggccugaacaccuccgugcugcgggccguccucccccgggacaugguguuccgcaccagcacgccccgggugguccuguga

SEQ ID NO: 991 - RNA, 1710 nt, Artificial Sequence
  derived and/or modified CDS sequence (opt1) from Lassa virus__AIT17245__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggacggggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcacgagcaucaccggccgggccugggagaacaccguggucgaccucgaguccgacgggaagccccagaaggcgggcagcaacaacuccaacaagagccugcaguccgccggccugaccgccgggcucacguacagccagcugaugacccugaaggacgccaugcugcagcucgacccgaacgccaagaccuggauggacaucgagggccgccccgaggaccccguggagaucgcgcuguaccagcccuccagcgggugcuacauccacuucuuccgggagccgaccgaccugaagcaguucaagcaggacgccaaguacucccacggcaucgacguggccgaccucuucgccgcccagcccgggcugacgagcgcggucaucgacgcccugccccgcaaccucgugaucacgugccagggcuccgacgacauccgcaagcugcuggagagccagggccggaaggacaucaagcucaucgacaucgcccugagcaagaccgacucccgcaaguacgagaacgccgugugggaccaguacaaggaccugugccacaugcacaccgggaucgucguggagaagaagaagcggggcgggaaggaggagaucaccccgcacugcgcgcucauggacugcaucauguucgacgccgccgucagcggcgggcugaacgccuccgugcugcgcgccgugcucccccgggacauggucuuccgcaccagcacgccccggguggugcuguga

SEQ ID NO: 992 - RNA, 1710 nt, Artificial Sequence
  derived and/or modified CDS sequence (opt1) from Lassa virus__AIT17247__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucauccuggccgccgaccuggagaagcucaagagcaaggugauccggaccgagcgcccccuguccagcgggguguacaugggcaaccuguccagccagcagcucgaccagcggcgcgcccugcugaacaugaucgggauguccggcggcaaccagggggcgcaggucggccgggacgggguggugcgcgucugggacgugaagaacgccgaccuccugaacaaccaguucggcaccaugccgagccugacgcucgccugccugaccaagcagggccagguggaccugaacgacgucgugcaggcccucaccgaccuggggcugaucuacaccgcgaaguaccccaacacguccgaccucgaccggcuggcccagagccaccccauccugaacaugaucgacaccaagaaguccagccucaacaucagcggcuacaacuucucccugggggccgccgugaaggccggcgcgugcaugcuggacgggggcaacaugcucgagaccaucaaggucagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaaggccggcuccaacaacagcaacaagucccugcagagcgcgggguucacggccggccugaccuacucccagcucaugacccugaaggacagcaugcugcagcuggacccgaacgccaagaccuggauggacaucgaggggcggcccgaggaccccgucgagguggcccucuaccagcccuccagcggcugcuacauccacuucuuccgcgagccgacggaccugaagcaguucaagcaggacgccaaguacucccacgggaucgacgugaccgaccuguucgcggcccagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgcggucugggaccaguacaaggaccucugccacaugcacaccggcgugguggucgagaagaagaagcgcgggggcaaggaggagaucacgccccacugcgcccugauggacugcaucauguucgacgccgccguguccgggggccugaagacccucgugcugcgggcgguccugccgcgcgacaugguguuccggaccagcacccccaaggugguccucuga

SEQ ID NO: 993 - RNA, 1710 nt, Artificial Sequence
  derived and/or modified CDS sequence (opt1) from Lassa virus__AIT17251__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucauccuggccgccgaccuggagaagcucaagagcaaggugauccggaccgagcgcccccuguccagcgggguguacaugggcaaccuguccagccagcagcucgaccagcggcgcgcccugcugaacaugaucgggauguccggcggcaaccagggggcgcaggucggccgggacgggguggugcgcgucugggacgugaagaacgccgaccuccugaacaaccaguucggcaccaugccgagccugacgcucgccugccugaccaagcagggccagguggaccugaacgacgucgugcaggcccucaccgaccuggggcugaucuacaccgcgaaguaccccaacacguccgaccucgaccggcuggcccagagccaccccauccugaacaugaucgacaccaagaaguccagccucaacaucagcggcuacaacuucucccugggggccgccgugaaggccggcgcgugcaugcuggacgggggcaacaugcucgagaccaucaaggucagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaagacgggcuccaacaacagcaacaagucccugcagagcgccggguucaccgcgggccugaccuacucccagcucaugacccugaaggacagcaugcugcagcuggacccgaacgccaagacguggauggacaucgaggggcggcccgaggaccccgucgagguggcccucuaccagcccuccagcggcugcuacauccacuucuuccgcgagccgaccgaccugaagcaguucaagcaggacgccaaguacucccacgggaucgacgugaccgaccuguucgccgcgcagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgccgucugggaccaguacaaggaccucugccacaugcacaccggcgugguggucgagaagaagaagcgcgggggcaaggaggagaucacgccccacugcgcgcugauggacugcaucauguucgacgccgccguguccgggggccugaagacccucgugcugcgggccguccugccgcgcgacaugguguuccggaccagcacccccaaggugguccucuga

SEQ ID NO: 994 - RNA, 1710 nt, Artificial Sequence
  derived and/or modified CDS sequence (opt1) from Lassa virus__AIT17255__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagcgggcccaggccgggcgcgacggcguggugcgggucugggacgugaagaacgccgagcuccugaacaaccaguucgggacgaugccgucccugacccucgcgugccugaccaagcagggccagguggaccugaacgacgccguccaggcccucaccgaccuggggcugaucuacacggugaaguaccccaacgccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagaccaucaaggucagcccccagacgauggacggcauccucaagagcauccugaaggugaagaagacccugggcauguucaucuccgacaccccgggggagcggaaccccuacgagaacauccuguacaagaucugccugagcggcgacggguggcccuacaucgccucccgcaccagcaucacgggccgggccugggagaacaccguggucgaccucgaguccaacgggaagccccagaaggcggacagcaacuccagcaacaagucccugcagagcgccggcuucaccgccggccugaccuacucccagcucaugacgcugaaggacgccaugcugcagcuggacccgaacgccaagaccuggauggacaucgaggggcgccccgaggaccccguggagaucgcguucuaccagcccagcuccggcugcuacauccacuucuuccgggagccgaccgaccucaagcaguucaagcaggacgccaaguacagccacgggaucgacgugaccgaccuguucgccgcccagcccggccugacguccgccgucaucgacgcgcucccccgcaacauggugaucacgugccaggggagcgacgacauccgcaagcugcuggagagccagggccggaaggacaucaagcucaucgacaucgcccuguccaagaccgacagccgcaaguacgagaacgccgucugggaccaguacaaggaccugugccacaugcacaccggcgugguggucgagaagaagaagcgcgggggcaaggaggagaucaccccgcacugcgcccucauggacugcaucauguucgacgcggccguguccgggggccugaacacccuggugcuccgggccguccugccccgggacaugguguuccgcaccagcacgccccgggugguccuguga

SEQ ID NO: 995 - RNA, 1710 nt, Artificial Sequence
  derived and/or modified CDS sequence (opt1) from Lassa virus__AIT17259__NP
augagcgccuccaaggagaucaagagcuuccuguggacccagucccuccgccgggagcugagcuccuacugcagcaacaucaagcuccagguggucaaggacgcccaggcgcugcugcacggccuggacuucuccgaggugagcaacgugcagcgccucaugcggaaggagcgccgggacgacaacgaccugaagcgccugcgggaccucaaccaggccgucaacaaccugguggagcugaaguccacccagcagaaguccauccuccgcguggggacccugaccagcgacgaccugcucauccuggccgccgaccuggagaagcucaagagcaaggucacccggaccgagcgcccccuguccgccggcguguacauggggaaccugagcucccagcagcucgaccagcggcgcgcgcugcugaacaugcucggcaugagcggguccaaccagggcgcccgggccggccgcgacggggugguccgggugugggacgugaagaacgccgagcugcugaacaaccaguucggcacgaugccgagccucacccuggcgugccugaccaagcaggggcaggucgaccucaacgacgccgugcaggcccugaccgaccugggccucaucuacacggccaaguaccccaacaccuccgaccuggaccgccugacccagagccaccccauccucaacaugaucgacaccaagaaguccagccugaacaucagcggguacaacuucucccugggcgccgcggugaaggccggcgccugcaugcucgacgggggcaacaugcuggagacgaucaaggucagcccccagaccauggacgggauccugaaguccauccucaaggugaagaaggcccugggcauguucaucagcgacaccccgggcgagcggaaccccuacgagaacauccuguacaagaucugccucuccggggacggcuggcccuacaucgccagccgcaccuccaucacggggcgggcgugggagaacaccguggucgaccuggagagcgacggcaagccccagaaggccggguccaacagcuccaacaagagccugcaguccgccggcuucaccgccggccucaccuacagccagcugaugacgcugaaggacgccaugcugcagcucgacccgaacgcgaagaccuggauggacaucgaggggcgccccgaggaccccguggagaucgcccuguaccagcccuccagcggcugcuacauccacuucuuccgggagccgaccgaccugaagcaguucaagcaggacgccaaguacucccacgggaucgacgugaccgaccucuucgccgcccagcccggccugacgagcgcggucaucgacgcccugccccgcaacauggugaucacgugccaggggagcgacgacauccgcaagcuccuggagucccagggccggaaggacaucaagcugaucgacaucgcccucagcaagaccgacucccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucagcgggggccucaacgccuccgugcugcgggccgugcugccccgggacauggucuuccgcaccagcacgccccggguggugcucuga

SEQ ID NO: 996 - RNA, 1710 nt, Artificial Sequence
  derived and/or modified CDS sequence (opt1) from Lassa virus__AIT17263__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacggucguggaccucgagagcgacggcaagccccagaaggccggcuccaacgggagcaacaagucccugcagagcgccggcuucaccgccgggcugaccuacucccagcucaugacccugaaggacgccaugcugcagcuggacccgaacacgaagaccuggauggacaucgagggccgccccgaggaccccguggaggucgcgcucuaccagcccagcuccgggugcuacauccacuucuuccgggagccgaccgaccugaagcaguucaagcaggacgccaaguacagccacggcaucgacgugaccgaccuguucgccgcccagcccggccucacguccgccgugaucgacgcgcugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucgucguggagaagaagaagcggggcgggaaggaggagaucaccccgcacugcgcccugauggacugcaucauguucgacgcggccguguccggcggccugaacaccagcguccuccgcgccgugcugccccgggacaugguguuccgcaccuccacgccccgggucgugcuguga

SEQ ID NO: 997 - RNA, 1710 nt, Artificial Sequence
  derived and/or modified CDS sequence (opt1) from Lassa virus__AIT17267__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggguggucguggagaagaagaagcggggcgggaaggaggagaucacgccccacugcgcccugauggacugcaucauguucgacgccgccgugagcggcgggcugaacaccuccguccuccgcgccgugcugccgcgggacaugguguuccgcaccaccacgccccgggucgugcuguga

SEQ ID NO: 998 - RNA, 1710 nt, Artificial Sequence
  derived and/or modified CDS sequence (opt1) from Lassa virus__AIT17271__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaagaccauccugaaggugaagaaggcccucgggauguucaucuccgacaccccgggcgagcggaaccccuacgagaacauccuguacaagaucugccugagcggggacggcuggcccuacaucgccucccgcacgagcaucaccgggcgggcgugggagaacaccguggucgaccucgaguccgacggcaagccccagaagaccggcagcaacaacuccaacaagagccugcaguccgccggguucgccgccggccugacguacagccagcucaugacccugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugacggaccuguucgccgcccagcccggccucaccagcgcggucaucgacgcccugccccgcaacauggugaucacgugccagggcuccgacgacauccgcaagcugcucgagagccaggggcggaaggacaucaagcugaucgacaucgcccuguccaaggccgacagccgcaaguacgagaacgcggugugggaccaguacaaggaccucugccacaugcacaccggcgucguggucgagaagaagaagcgcgggggcaaggaggagaucaccccgcacugcgcccugauggacugcaucauguacgacgccgccgugagcgggggccuguccaccagcgugcuccgggccguccugccccgggacaugguguuccgcaccuccacgccccgggugguccuguga

SEQ ID NO: 999 - RNA, 1710 nt, Artificial Sequence
  derived and/or modified CDS sequence (opt1) from Lassa virus__AIT17275__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcugaaguccacccagcagaaguccgugcuccgcgucgggacgcugaccagcgacgaccugcucacccuggccgccgaccuggagaagcucaaguccaaggugacccggacggagcgcccccugagcgccggcguguacauggggaaccuguccagccagcagcucgaccagcggcgcgcgcugcugaacaugaucggcauguccggcgggaaccagggcgcccggaccgggaaggacggcgucgugcgcaucugggacgugaagaacgccgaccuccugaacaaccaguucgggaccaugccgagccugacccucgccugccugacgaagcagggccaggucgaccugaacgacguggugcaggcgcucaccgaccugggccugaucuacaccgccaaguaccccaacaucuccgaccucgaccggcuggcccagagccaccccauccugaagaugaucgacaccuccaagagcagccucaacaucuccggguacaacuucagccugggcgccgccgucaaggcgggggccugcaugcuggacggcggcaacaugcucgagacggugaaggugagcccccagaccauggacgggauccucaagagcauccugaaggucaagaagucccugggcauguucaucagcgacaccccgggggagcgcaaccccuacgagaacauccuguacaagaucugccuguccggcgacggguggcccuacaucgccagccggaccuccaucacgggccgcgccugggagaacaccgugguggaccucgagagcgacggcaagccccagaaggucggguccaacaacagcaacaagucccugcagagcaccggcuucaccgccgggcugacguacucccagcucaugacccugaaggacgcgaugcugcagcuggacccgaacgccaagaccuggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugacggaccuguucgccgcgcagcccggccucaccuccgccgucaucgacacccugccccggaacauggugaucacgugccaggggagcgacgacaucggcaagcugcucgagagccaggggcgcaaggacaucaagcugaucgacaucgcccuguccaagaccgacagccgcaaguacgagaacgccgucugggaccaguacaaggaccucugccacaugcacaccggcgugguggucgagaagaagaagcgcgggggcaaggaggagaucaccccgcacugcgcccugauggacugcaucauguucgacgcggccguguccggcgggcugaacgccagcgugcuccgggccguccugccccgggacaugguguuccgcaccuccacgccccgggugguccuguga

SEQ ID NO: 1000 - RNA, 1710 nt, Artificial Sequence
  derived and/or modified CDS sequence (opt1) from Lassa virus__AIT17277__NP
augagcgccuccaaggagaucaagagcuuccuguggacccagucccuccgccgggagcugagcuccuacugcagcaacaucaagcuccagguggucaaggacgcccaggcgcugcugcacggccuggacuucuccgaggugagcaacgugcagcgccucaugcggaaggagcgccgggacgacaacgaccugaagcgccugcgggaccucaaccaggccgucaacaaccugguggagcugaaguccacccagcagaaguccauccuccgcguggggacccugaccuccgacgaccugcucauccuggccgccgaccuggagaagcucaagagcaaggucacccggaccgagcgcccccuguccgccggcguguacauggggaaccugagcucccagcagcucgaccagcggcgcgcgcugcugagcaugaucggcauguccgggagcaaccagggcgcccgggccggccgcgacggggugguccgggugugggacgugaagaacgccgagcuccugaacaaccaguucggcacgaugccgucccugacccucgcgugccugaccaagcaggggcaggucgaccugaacgacgccgugcaggcccucaccgaccugggccugaucuacacggccaaguaccccaacaccagcgaccucgaccgccugacccagagccaccccauccugaacaugaucgacaccaagaaguccagccucaacaucuccggguacaacuucagccugggcgccgcggugaaggccggcgccugcaugcuggacgggggcaacaugcucgagacgaucaaggucagcccccagaccauggacgggauccucaagagcauccugaaggugaagaaggcccugggcauguucaucuccgacaccccgggcgagcggaaccccuacgagaacauccuguacaagaucugccugagcggggacggcuggcccuacaucgccucccgcaccagcaucacggggcgggcgugggagaacaccguggucgaccucgaguccgacggcaagccccagaaggccgggagcaacaacuccaacaagagccugcaguccgccggcuucaccgccggccugaccuacagccagcucaugacgcugaaggacgccaugcugcagcuggacccgaacgcgaagaccuggauggacaucgaggggcgccccgaggaccccguggagguggcccucuaccagcccuccagcggcugcuacauccacuucuuccgggagccgaccgaccugaagcaguucaagcaggacgccaaguacucccacgggaucgacgucaccgaccuguucgccgcccagcccggccucacgagcgcggugaucgacgcccugccccgcaacauggugaucacgugccaggggagcgacgacauccgcaagcugcucgagucccagggccggaaggacaucaagcugaucgacaucgcccugagcaagaccgacucccgcaaguacgagaacgccgucugggaccaguacaaggaccucugccacaugcacaccggcguggucguggagaagaagaagcgcgggggcaaggaggagaucaccccgcacugcgcgcugauggacugcaucauguucgacgccgccgugagcgggggccugaacaccuccguccuccgggccgugcugccccgggacaugguguuccgcaccagcacgccccgggucgugcuguga

SEQ ID NO: 1001 - RNA, 1710 nt, Artificial Sequence
  derived and/or modified CDS sequence (opt1) from Lassa virus__AIT17281__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggcccgggccggccgcgacgggguggugcggaucugggacgucaagaacgccgagcuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccuccaccacgaacagcaacaagucccugcagagcgcgggcuucgccgccgggcugaccuacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgacggaccugaagcaguucaagcaggacgccaaguacagccacggcaucgacgucaccgaccuguucgccgcccagcccgggcucaccuccgccgugaucgacacccugccccgcaacauggugaucacgugccagggcagcgaggacauccgccggcugcucgagagccagggccgcaaggacaucaagcugaucgacaucgcgcuguccaagaccgacagccggaaguacgagaacgccgucugggaccaguacaaggaccucugccacaugcacaccgggguggucguggagaagaagaagaagggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcuguga

SEQ ID NO: 1002 - RNA, 1710 nt, Artificial Sequence
  derived and/or modified CDS sequence (opt1) from Lassa virus__AIT17285__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgcagcaugcggaaggagcgccgggacgacaacgaccucaagcgccugcgggaccugaaccaggccgucaacaaccucguggagcugaaguccacccagcagaaguccauccugcgcgugggcacccucaccagcgacgaccugcugauccucgccgccgaccuggagaagcucaagagcaaggucacccggaccgagcgcccccuguccgccgggguguacaugggcaaccugagcucccagcagcuggaccagcggcgcgcgcuccugaacaugaucgggaugagcggcuccaaccagggcgcccgggccgggcgcgacggcgugguccgggugugggacgugaagaacgccgagcugcucaacaaccaguucgggacgaugccgagccugacccuggcgugccucaccaagcagggccaggucgaccugaacgacguggugcaggcccugaccgaccucgggcugaucuacacggccaaguaccccaacgccuccgaccuggaccgccucacccagagccaccccauccugaacaugaucgacaccaagaaguccagccugaacaucagcggcuacaacuucucccucggcgccgcggucaaggccggggccugcaugcuggacggcgggaacaugcuggagaccaucaaggugagcccccagacgauggacggcauccucaaguccauccugaaggugaagaaggcccugggcauguucaucagcgacaccccgggggagcggaaccccuacgagaacauccucuacaagaucugccuguccggcgacggguggcccuacaucgccagccgcaccuccaucaccggccgggcgugggagaacacgaucgucgaccuggagagcgacgggaagccccagaaggccggcaacaacggcuccaacaagagccuccaguccgccggguucaccgccggccugaccuacagccagcugaugacccucaaggacgccaugcugcagcuggacccgaacgcgaagacguggauggacaucgaggggcgccccgaggaccccguggagaucgcccuguaccagcccuccagcggcugcuacauccacuucuuccgggagccgaccgaccucaagcaguucaagcaggacgccaaguacucccacgggaucgacgugaccgaccuguucgccgcccagcccggccugaccagcgcggucaucgacgcccucccccgcaaccuggugaucacgugccagggcuccgacgacauccgcaagcugcucgagagccaggggcggaaggacaucaagcugaucgacaucgcccugagcaagaccgacucccgcaaguacgagaacgccgugugggaccaguacaaggaccucugccacaugcacaccggcaucgucguggagaagaagaagcgcgggggcaaggaggagaucacgccccacugcgcgcugauggacugcaucauguucgacgccgccgucagcgggggccugaacaccuccgugcuccgggccgugcugccgcgggacauggucuuccgcaccagcacgccccggguggugcuguga

SEQ ID NO: 1003 - RNA, 1710 nt, Artificial Sequence
  derived and/or modified CDS sequence (opt1) from Lassa virus__AIT17289__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggugcgggccggccgcgacggggugguccggaucugggacgugaagaacgccgagcuccugaacaaccaguucggcacgaugccgagccugacccucgccugccugaccaagcagggccagguggaccugaacgacgucgugcaggcgcucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggccggcgcgugcaugcuggacgggggcaacaugcucgagacgaucaaggucagcccccagaccauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccggcuccaucaacagcaacaagucccugcagagcaccggguucgccgcgggccugacguacucccagcucaugacccugaaggacgccaugcugcagcuggacccgaacgccaagaccuggauggacaucgaggggcgccccgaggaccccgucgagaucgcccucuaccagcccagcuccggcugcuacauccacuucuuccgggagccgaccgaccugaagcaguucaagcaggacgccaaguacagccacgggaucgacgugacggaccuguucgcggcccagcccggccucaccuccgccgugaucgacgcccugccccgcaacauggucaucacgugccagggcagcgacgacauccgcaagcugcucgagagccaggggcggaaggacaucaagcugaucgacaucgcccuguccaagaccgacagccgcaaguacgagaacgcggugugggaccaguacaaggaccucugccacaugcacaccggcaucgucguggagaagaagaagcgcgggggcaaggaggagaucaccccgcacugcgcccugauggacugcaucauguucgacgccgccguguccgggggccugaacaccagcguccuccgggcggugcugccccgggacaugguguuccgcaccuccacgccccgggucgugcuguga

SEQ ID NO: 1004 - RNA, 1710 nt, Artificial Sequence
  derived and/or modified CDS sequence (opt1) from Lassa virus__AIT17293__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaaguccaaggugacccggaccgagcgcccccugagcgccggggucuacaugggcaaccuguccacgcagcagcucgaccagcggcgcgcgcugcugaacaugaucgggaugagcggcggcaaccagggggcccgggccggccgcgacgggguggugcgggucugggacgugaagaacgccgaccuccugaacaaccaguucggcaccaugccgucccugacccucgcgugccugaccaagcagggccagguggaccugaacgacgucgugcaggcccucacggaccuggggcugaucuacaccgccaaguaccccaacaccagcgaccucgaccgccugacccagucccaccccauccugaacaugaucgacacgaacaagagcucccucaacaucagcggcuacaacuucagccugggggccgccgugaaggcgggcgccugcaugcuggacgggggcaacaugcucgagaccaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccguggucgaccucgaguccgacggcaagccccagaaggcgggcgggaacaacagcaacaagucccugcagagcgccggcuucaccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgugacggaccuguucgccgcccagcccggccucaccuccgccgucaucgacgcgcugccccgcaacauggugaucacgugccaggggagcgacgacauccgcaagcugcucgagucccagggccggaaggacaucaagcugaucgacaucgcccugagcaagaccgacucccgcaaguacgagaacgccgucugggaccaguacaaggaccucugcaacaugcacaccgggaucgugguggagaagaagaagcggggcgggaaggaggagaucaccccgcacugcgcccugauggacugcaucauguucgacgcggccgucagcggcggcaugaacaccagcgugcugcgcgccgugcucccccgggacauggucuuccgcaccuccacgccccggguggugcuguga

SEQ ID NO: 1005 - RNA, 1710 nt, Artificial Sequence
  derived and/or modified CDS sequence (opt1) from Lassa virus__AIT17295__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacgaucgucgaccucgagagcgacggcaagccccagaaggccggcuccaacgggagcaacaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccgcccagcccggccucaccuccgcgaucaucgacgcccugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucguggucgagaagaagaagcggggcgggaaggaggagaucacgccccacugcgcgcugauggacugcaucauguucgacgccgccguguccggcggccugaacaccagcguccuccgcgccgugcugccgcgggacaugguguuccgcaccuccacgccccgggucgugcuguga

SEQ ID NO: 1006 - RNA, 1710 nt, Artificial Sequence
  derived and/or modified CDS sequence (opt1) from Lassa virus__AIT17299__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcuguccaugaucgggaugagcggcggcaaccagggggcccggacgggccgcgacgggguggugcgggucugggacgugaagaacgccgagcuccugaacaaccaguucggcaccaugccgucccugacccucgccugccugaccaagcagggccagguggaccugaacgacgucgugcaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggucagcccccagaccauggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccguggucgaccucgaguccgacggcaagccccagaaggccggcagcaacaacuccaacaagagccugcaguccgcgggguucaccgccggccugacguacagccagcucaugacccugaaggacgccaugcugcagcuggacccgaacgccaagaccuggauggacaucgaggggcgccccgaggaccccguggagaucgcccucuaccagcccuccagcggcugcuacauccacuucuuccgggagccguccgaccugaagcaguucaagcaggacgcgaaguacagccacgggaucgacgugaccgaccuguucgccgcccagcccggccucacguccgccgucaucgacgcccugccccgcaacauggugaucacgugccagggcagcgacgacauccgcaagcuguucgagagccaggggcggaaggacaucaagcucaucgacaucgcgcuguccaagaccgacagccgcaaguacgagaacgccgucugggaccaguacaaggaccugugccacaugcacaccggcgugguggucgagaagaagaagcgcgggggcaaggaggagaucaccccgcacugcgcccucauggacugcaucauguucgacgccgcgguguccgggggccugaacagccuggugcuccgggccguccugccccgggacaugguguuccgcaccuccacgccccgggugguccuguga

SEQ ID NO: 1007 - RNA, 1710 nt, Artificial Sequence
  derived and/or modified CDS sequence (opt1) from Lassa virus__AIT17303__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcugguccagagccaccccauccugaacaugaucgacaccaagaaguccagccucaacaucagcggcuacaacuucucccugggggccgccgugaaggccggcgccugcaugcuggacgggggcaacaugcucgagaccaucaaggugagcccccagaccauggacggcauccugaaguccauccugaaggucaagaaggcgcucgggauguucaucagcgagacgccgggcgagcgcaaccccuacgagaacauccuguacaagaucugccuguccggggacggcuggcccuacaucgccagccggaccuccaucaccgggcgcgccugggagaacaccaucguggaccucgagagcgacggcaagccccagaaggccggcuccaacaacagcaacaagucccugcagagcgccggguucacggcgggccugaccuacucccagcucaugacccugaaggacagcaugcugcagcuggacccgaacgccaagaccuggauggacaucgaggggcggcccgaggaccccguggaggucgcccucuaccagcccuccagcggcugcuacauccacuucuuccgcgagccgacggaccugaagcaguucaagcaggacgccaaguacucccacgggaucgacgugaccgaccuguucgccgcgcagcccggccucaccagcgccgucaucgaggcccugccccggaacauggugaucacgugccagggcagcgacgacauccgcaagcugcucgagucccaggggcgcaaggacaucaagcugaucgacaucgcccugaacaagaccgacagccggaaguacgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaagacccucgugcugcgggccgugcugccgcgcgacauggucuuccggaccagcacccccaagguggugcucuga

SEQ ID NO: 1008 - RNA, 1710 nt, Artificial Sequence
  derived and/or modified CDS sequence (opt1) from Lassa virus__AIT17307__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacgcugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcuguccaugaucgggaugagcggcggcaaccagggggcccggacgggccgcgacggggucgugcgggugugggacgucaagaacgccgagcuccugaacaaccaguucggcaccaugccgucccugacccucgccugccugaccaagcagggccagguggaccugaacgacgugguccaggcgcucacggaccuggggcugaucuacaccgccaaguaccccaacaccagcgaccucgaccgccugacccagucccaccccauccugaacaugaucgacacgaagaaguccagccucaacaucuccggcuacaacuucagccugggggccgccgugaaggccggcgcgugcaugcuggacgggggcaacaugcucgagaccaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcacgagcaucaccgggcgggccugggagaacaccgugguggaccucgaguccgacggcaagcugcagaagaccggcagcaacaacuccaacaagagccugcaguccgccggguucacggcgggccucaccuacagccagcugaugacccugaaggacgccaugcugcagcucgaccccaacgccaagaucuggauggacaucgaggggcgcccggaggaccccgucgagaucgcccuguaccagcccuccagcggcugcuacauccacuucuuccgggagcccaccgaccugaagcaguucaagcaggacgccaaguacucccacgggaucgacgugacggaccucuucgcggcccagccgggccugaccagcgccgugaucgacgcccugccccgcaacauggucaucacgugccagggcuccgacgacauccgcaagcuccuggagagccaggggcggaaggacaucaagcugaucgacaucgcccucaacaagaccgacagccgcaaguacgagaacgcggugugggaccaguacaaggaccugugccacaugcacaccggcgucgugguggagaagaagaagaagggcgggaaggaggagaucacgccccacugcgcccugauggacugcaucauguucgacgccgccgucuccgggggccucaacaccagcgugcugcgggcggugcugccccgcgacauggucuuccggaccuccaccccgcgcguggugcucuga

SEQ ID NO: 1009 - RNA, 1710 nt, Artificial Sequence
  derived and/or modified CDS sequence (opt1) from Lassa virus__AIT17311__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugauccggaccgagcgcccccugagcgccgggguguacaugggcaaccuguccagccagcagcucgaccagcggcgcgcgcugcugaacaugaucgggaugggcggcuccaaccagggggcccgggccggccgcgacggggucgugcgggugugggacgucaagaacgccgagcuccugaacaaccaguucggcaccaugccgagccugacgcucgcgugccugaccaagcagggccagguggaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagaccaucaaggugagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacggucguggaccucgagagcgacggcaagccccagaaggccggcuccaacgggagcaacaagucccugcagagcgccggcuucaccgccgggcugaccuacucccagcucaugacccugaaggacgccaugcugcagcuggacccgaacgcgaagacguggauggacaucgagggccgccccgaggaccccguggaggucgcccucuaccagcccagcuccgggugcuacauccacuucuuccgggagccgaccgaccugaagcaguucaagcaggacgccaaguacagccacggcaucgacgugaccgaccuguucgccgcccagcccggccucaccuccgcggugaucgacgcccugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccgggaucgucguggagaagaagaagcggggcgggaaggaggagaucacgccccacugcgcgcugauggacugcaucauguucgacgccgccguguccggcggccugaacaccagcguccuccgcgccgugcugccgcgggacaugguguuccgcaccuccacgccccgggucgugcuguga

SEQ ID NO: 1010 - RNA, 1710 nt, Artificial Sequence
  derived and/or modified CDS sequence (opt1) from Lassa virus__AIT17315__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgucgugcgggugugggacgucaagaacguggagcuccugaacaaccaguucgggacgaugccgucccugacccucgccugccugaccaagcagggccagguggaccugaacgacgcgguccaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgacaccccgggggagcggaaccccuacgagaacauccuguacaagaucugccugagcggcgacggguggcccuacaucgccucccgcaccagcaucacgggccgggccugggagaacaccgugguggaccucgaguccgacgggaagccccagaaggcgggcagcaacuccagcaacaagucccugcagagcgccggcuucaccgccgggcugaccuacucccagcucaugacgcugaaggacgccaugcugcagcuggacccgaacgccaagaccuggauggacaucgagggccgccccgaggaccccgucgagaucgcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgugaucgacgcgcugccccgcaacauggucaucacgugccagggcagcgacgacauccgcaagcugcucgagagccagggccggaaggacaucaagcugaucgacaucgcccuguccaagaccgacagccgcaaguacgagaacgccgugugggaccaguacaaggaccucugccacaugcacaccgggaucgucguggagaagaagaagaagggcuccaaggaggagaucaccccgcacugcgcccugauggacugcaucauguucgacgcggccgugagcgggggccugaacgccuccguccuccgggccgugcugccccgcgacaugguguuccggaccagcacgccccgcgucgugcuguga

SEQ ID NO: 1011 - RNA, 1710 nt, Artificial Sequence
  derived and/or modified CDS sequence (opt1) from Lassa virus__AIT17319__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggacaugcucaacaaccaguucggcaccaugccgagccugacgcuggccugccucaccaagcaggggcaggucgaccugaacgacguggugcaggcccugaccgaccucggccugaucuacaccgcgaaguaccccaacacguccgaccuggaccggcucgcccagagccaccccauccugaacaugaucgacaccaagaaguccagccugaacaucagcggcuacaacuucucccucggggccgccgucaaggccggcgcgugcaugcuggacgggggcaacaugcuggagaccaucaaggugagcccccagaccauggacggcauccucaaguccauccugaaggugaagaaggcccuggggauguucaucagcgagacgccgggcgagcgcaaccccuacgagaacauccucuacaagaucugccuguccggggacggcuggcccuacaucgccagccggaccuccaucaccgggcgcgccugggagaacaccaucgucgaccuggagagcgacggcaagccccagaaggccggcuccaacaacagcaacaagucccuccagagcgcgggguucacggccggccugaccuacucccagcugaugacccucaaggacagcaugcugcagcuggacccgaacgccaagaccuggauggacaucgaggggcggcccgaggaccccguggagguggcccuguaccagcccuccagcggcugcuacauccacuucuuccgcgagccgacggaccucaagcaguucaagcaggacgccaaguacucccacgggaucgacgucaccgaccuguucgcggcccagcccggccugaccagcgccgugaucgaggcccucccccggaacauggucaucacgugccagggcagcgacgacauccgcaagcugcuggagucccaggggcgcaaggacaucaagcucaucgacaucgugcugaacaagaccgacagccggaaguacgagaacgccgugugggaccaguacaaggaccugugccacaugcacaccggcgucgugguggagaagaagaagcgcgggggcaaggaggagaucacgccccacugcgcgcucauggacugcaucauguucgacgccgccgucuccgggggccugaagaccauggugcugcgggccgugcucccgcgcgacauggucuuccggaccagcacccccaagguggugcuguga

SEQ ID NO: 1012 - RNA, 1710 nt, Artificial Sequence
  derived and/or modified CDS sequence (opt1) from Lassa virus__AIT17323__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcuggcccagagccaccccauccugaacaugaucgacaccaagaaguccagccucaacaucagcggcuacaacuucucccugggggccgccgucaaggccggcgcgugcaugcuggacgggggcaacaugcucgagaccaucaaggugagcccccagaccauggacggcauccugaaguccauccugaaggugaagaaggcccucgggauguucaucagcgagacgccgggcgagcgcaaccccuacgagaacauccuguacaagaucugccuguccggggacggcuggcccuacaucgccagccggaccuccaucaccgggcgcgccugggagaacaccaucgucgaccucgagagcgacggcaagccccagaaggccggcuccaacaacagcaacaagucccugcagagcgcgggguucacggccggccugaccuacucccagcucaugacccugaaggacagcaugcugcagcuggacccgaacgccaagaccuggauggacaucgaggggcggcccgaggaccccguggagguggcccucuaccagcccuccagcggcugcuacauccacuucuuccgcgagccgacggaccugaagcaguucaagcaggacgccaaguacucccacgggaucgacgucaccgaccuguucgcggcccagcccggccucaccagcgccgugaucgaggcccugccccggaacauggucaucacgugccagggcagcgacgacauccgcaagcugcucgagucccaggggcgcaaggacaucaagcugaucgacaucgcccugaacaagaccgacagccggaaguacgagaacgcggugugggaccaguacaaggaccucugccacaugcacaccggcguggucguggagaagaagaagcgcgggggcaaggaggagaucacgccccacugcgcccugauggacugcaucauguucgacgccgccguguccgggggccugaagacccucguccugcgggcggugcugccgcgcgacaugguguuccggaccagcacccccaaggucgugcucuga

SEQ ID NO: 1013 - RNA, 1710 nt, Artificial Sequence
  derived and/or modified CDS sequence (opt1) from Lassa virus__AIT17325__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucgugcuggccgccgaccuggagaagcucaaguccaaggugacccggaccgagcgcccccugagcgccggggucuacaugggcaaccuguccagccagcagcucgaccagcggcgcgcgcugcugaacaugaucgggaugacgggcggcucccgcggggcccaggccggcggggacggcguggugcgggucugggacgugaagaacgccgaccuccugaacaaccaguucgggaccaugccgagccugacccucgcgugccugaccaagcagggccagguggaccugaacgacgucgugcaggcccucacggaccugggccugaucuacaccgccaaguaccccaacaccuccgaccucgaccggcugacccagagccaccccauccugaacaugaucgacacgaagaaguccagccucaacaucagcggguacaacuucucccugggcgccgccgugaaggcgggggccugcaugcuggacggcggcaacaugcucgagaccaucaaggucagcccccagaccauggacgggauccugaaguccauccugaaggugaagaagucccucggcauguucaucagcgacaccccgggggagcgcaaccccuacgagaacauccuguacaagaucugccugagcggcgacggguggcccuacaucgccucccggacgagcaucaccggccgcgccugggagaacaccguggucgaccucgaguccgacggcaagccccagaaggccgggggcaacaacagcaacaagucccugcagagcgcgggguucaccgccggccugacguacucccagcucaugacccugaaggacaccaugcugcagcuggacccgaacgccaagaccuggauggacaucgaggggcggcccgaggaccccguggagguggcccucuaccagcccagcuccggcugcuacauccacuucuuccgcgagccgacggaccugaagcaguucaagcaggacgccaaguacagccacggcaucgacgucaccgaccuguucgcggcccagcccgggcucaccuccgccgugaucgaggcccugccccggaacauggucaucacgugccagggcagcgacgacauccgcaagcugcucgagucccaggggcgcaaggacaucaagcugaucgacaucgcccugagcaagguggacagccggaaguacgagaacgcggugugggaccaguacaaggaccucugccacaugcacaccggcgucgugguggagaagaagaagcgcgggggcaaggaggagaucacgccccacugcgcccugauggacugcaucauguucgacgccgccgucuccggcgggcugaacacccucgugcugcgggcggugcugccgcgcgacauggucuuccggaccagcacccccaagguggugcucuga

SEQ ID NO: 1014 - RNA, 1710 nt, Artificial Sequence
  derived and/or modified CDS sequence (opt1) from Lassa virus__AIT17329__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccagaccgucaacaaccugguggagcugaaguccacccagcagaaguccauccuccgcgugggcacccugaccagcgacgaccugcucauccuggccgccgaccuggagaagcucaagagcaaggucauccggaccgagcgcccccuguccgccgggguguacaugggcaaccugagcucccagcagcucgaccagcggcgcgcccugcugaacaugaucgggaugagcuccggcaaccagggcgcgcaggccgggcgggacggcgugguccgcgugugggacgugaagaacgccgagcuccugaacaaccaguucgggacgaugccgagccugacccucgccugccugaccaagcagggccaggucgaccugaacgacgcggugcaggcccucaccgaccuggggcugaucuacacggccaaguaccccaacaccuccgaccucgaccggcugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggucagcccccagaccauggacggcauccugaaguccauccugaaggugaagaaggcccucggcauguucaucagcgacaccccgggggagcgcaaccccuacgagaacauccuguacaagaucugccuguccggcgacggguggcccuacaucgccagccggaccuccaucacgggccgcgccugggagaacaccguggucgaccucgagagcgacgggaugccccagaaggcgggcuccagcuccagcaacaagucccugcagagcgccggcuucguggccgggcugaccuacucccagcucaugacccugaaggacgccaugcugcagcuggacccgaacgccaagacguggauggacaucgagggccggcccgaggaccccguggagaucgcgcucuaccagcccagcuccgggugcuacauccacuucuuccgcgagccgaccgaccugaagcaguucaagcaggacgccaaguacagccacggcaucgacgucaccgaccuguucgccgcccagcccgggcucaccagcgccgugaucgacgcgcugccccggaacauggugaucacgugccagggcuccgacgacauccgcaagcugcucgagagccagggccgcaaggacaucaagcugaucgacaucgcccuguccaaggccgacagccggaaguacgagaacgccgucugggaccaguacaaggaccucugccacaugcacaccgggguggucguggagaagaagaagcgcggcgggaaggaggagaucacgccccacugcgcgcugauggacugcaucauguacgacgccgccguguccggcgggcugaacaccagcguccuccgggccgugcugccgcgcgacaugguguuccggaccuccacgccccgcgucgugcuguga

SEQ ID NO: 1015 - RNA, 1710 nt, Artificial Sequence
  derived and/or modified CDS sequence (opt1) from Lassa virus__AIT17333__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccgugcugcgcgucggcacccugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgagcuccugaacaaccaguucggcacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgcggucaaggccggcgccugcaugcuggacgggggcaacaugcucgagacgaucaaggugagcccccagaccauggacuccauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccgucguggaccucgaguccgacgggaagccccagaaggccggcagcaacaacuccaacaagagccugcaguccgccggcuucgccgccgggcugaccuacagccagcucaugacccugaaggacgcgaugcugcagcuggacccgaacgccaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgucaccgaccuguucgccgcgcagcccgggcucaccagcgccgugaucgacgcccugccccgcaacauggugaucacgugccagggcuccgacgacauccgcaagcugcucgagagccagggccggaaggacaucaagcugaucgacaucgcccugagcaagaccgacucccgcaaguacgagaacgcggucugggaccaguacaaggaccucugccacaugcacaccgggaucguggucgagaagaagaagcggggcgggaaggaggagaucacgccccacugcgcccugauggacugcaucauguucgacgccgccgugagcggcgggcugaacaccuccgugcuccgcgccguccugccgcgggacaugguguuccgcaccagcacgccccgggugguccuguga

SEQ ID NO: 1016 - RNA, 1710 nt, Artificial Sequence
  derived and/or modified CDS sequence (opt1) from Lassa virus__AIT17335__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccauccuccgcgugggcacccugaccuccgacgaccugcucauccuggccgccgaccuggagaagcucaagagcaaggucacccggaccgagcgcccccuguccgccgggguguacaugggcaaccugagcucccagcagcucgaccagcggcgcgcgcugcugagcaugaucgggauguccagcggcgugcagggcgcccgggccgggcgcgacggcgucgugcgggugugggacgucaagaacgccgagcuccugaacaaccaguucgggacgaugccgucccugacccucgcgugccugaccaagcagggccagguggaccugaacgacgugguccaggcccucaccgaccuggggcugaucuacacggccaaguaccccaacaccagcgaccucgaccgccugacccagagccaccccauccugaacaugaucgacaccaagaaguccagccucaacaucuccggcuacaacuucagccugggcgccgccgugaaggcgggggccugcaugcuggacggcgggaacaugcucgagacgaucaaggugagcccccagaccauggacggcauccucaagagcauccugaaggucaagaaggcccugggcauguucaucuccgagaccccgggggagcggaaccccuacgagaacauccuguacaagaucugccugagcggcgacggguggcccuacaucgccucccgcaccagcaucacgggccgggccugggagaacaccgugguggaccucgaguccgacgggaagccccagaaggcgggcagcaacaacuccaacaagagccugcaguccaccggcuucgccgccgggcugaccuacagccagcucaugacgcugaaggacgccaugcugcagcuggacccgaacgccaagaccuggauggacaucgagggccgccccgaggaccccgucgagguggcgcucuaccagcccuccagcgggugcuacauccacuucuuccgggagccgaccgaccugaagcaguucaagcaggacgccaaguacucccacggcaucgacgugaccgaccuguucgccgcccagcccgggcucacgagcgccgucaucgacgcgcugccccgcaacauggugaucacgugccagggcagcgacgacaucaagaagcugcucgagucccagggccgcaaggacaucaagcugaucgacaucgcccugagcaagaccgacucccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccgugagcggcgggcugaacaccuccgugcuccgggccguccugccccgcgacaugguguuccggaccagcacgccccgcgugguccuguga

SEQ ID NO: 1017 - RNA, 1710 nt, Artificial Sequence
  derived and/or modified CDS sequence (opt1) from Lassa virus__AIT17341__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcacgaugccgagccugacccucgcgugccugaccaagcaggggcaggucgaccugaacgacgccgugcaggcccucaccgaccugggccugaucuacacggccaaguaccccaacaccuccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagacgaucaaggucagcccccagaccauggacggcauccugaaguccauccugaaggugaagaaggcccucgggauguucaucagcgacgccccgggcgagcggaaccccuacgagaacauccuguacaagaucugccuguccggggacggcuggcccuacaucgcgagccgcaccuccaucaccgggcgggccugggagaacacgguggucgaccucgagagcgacggcaagccccagaaggccggcuccaacgggagcaacaagucccugcagagcgccggcuucaccgccgggcugaccuacucccagcucaugacccugaaggacgcgaugcugcagcuggacccgaacgccaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgugaccgaccuguucgccgcgcagcccggccucaccuccgccgucaucgacgcccugccccgcaacauggugaucacgugccaggggagcgacgacauccgcaagcuguucgagucccagggccggaaggacaucaagcucaucgacaucgcccugagcaaggcggacagccgcaaguacgagaacgccgugugggaccaguacaaggaccugugccacaugcacaccggggucguggucgagaagaagaagcggggcgggaaggaggagaucacgccccacugcgcccucauggacugcaucauguucgacgccgccguguccggcggccugaacaccagcgugcugcgcgcgguccucccgcgggacaugguguuccgcaccuccacgccccgggugguccuguga

SEQ ID NO: 1018 - RNA, 1710 nt, Artificial Sequence
  derived and/or modified CDS sequence (opt1) from Lassa virus__AIT17345__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuguccaugaucgggaugagcuccggcgugcagggcgcccgggccgggcgcgacggcgucgugcgggugugggacgucaagaacgccgagcuccugaacaaccaguucgggacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggcgccgccgugaaggcgggggccugcaugcuggacggcgggaacaugcucgagacgaucaaggugagcccccagaccauggacggcauccugaaguccauccugaaggucaagaaggcccucggcauguucaucagcgagaccccgggggagcggaaccccuacgagaacauccuguacaagaucugccuguccggcgacggguggcccuacaucgccagccgcaccuccaucacgggccgggccugggagaacaccgugguggaccucgagagcgacgggaagccccagaaggcgggcuccaacaacagcaacaagucccugcagagcgccggcuucaccgccgggcugaccuacucccagcucaugacgcugaaggacgccaugcugcagcuggacccgaacgccaagaccuggauggacaucgagggccgccccgaggaccccgucgagguggcgcucuaccagcccagcuccgggugcuacauccacuucuuccgggagccgaccgaccugaagcaguucaagcaggacgccaaguacagccacggcaucgacgugaccgaccuguucgccgcccagcccgggcucacguccgccgucaucgacgcgcugccccgcaacauggugaucacgugccagggcagcgacgacaucaagaagcugcucgagagccagggccgcaaggacaucaagcugaucgacaucgcccuguccaagaccgacagccggaaguacgagaacgccgucugggaccaguacaaggaccucugccacaugcacaccggggugguggucgagaagaagaagcgcggcgggaaggaggagaucaccccgcacugcgcccugauggacugcaucauguucgacgcggccguguccggcgggcugaacaccagcgugcuccgggccguccugccccgcgacaugguguuccggaccuccacgccccgcgugguccuguga

SEQ ID NO: 1019 - RNA, 1710 nt, Artificial Sequence
  derived and/or modified CDS sequence (opt1) from Lassa virus__AIT17351__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcucaagagcacccagcagaaguccgugcugcgcgucgggacccugaccagcgacgaccugcucauccuggccgccgaccuggagaagcucaaguccaaggugauccggaccgagcgcccccugagcgccggcguguacauggggaaccuguccagccagcagcucgagcagcggcgcgcgcugcugaacaugaucggcauguccagcggcaaccagggggcccggaccggcaaggacggggucgugcgcaucugggacgugaagaacgccgaccuccugaacaaccaguucggcaccaugccgucccugacccucgccugccugaccaagcaggggcaggucgaccugaacgacguggugcaggcgcucaccgaccugggccugaucuacacggccaaguaccccaacaccagcgaccucgaccggcugacccagucccaccccauccugaacauggucgacaccagcaagagcucccucaacaucagcggcuacaacuucucccugggggccgccgugaaggccggcgcgugcaugcuggacgggggcaacaugcucgagacgaucaaggugagcccccagaccauggacggcauccugaaguccauccugaaggucaagaagucccucgggauguucgugagcgacaccccgggcgagcgcaaccccuacgagaacauccuguacaagaucugccugagcggggacggcuggcccuacaucgccucccggaccagcaucacggggcgcgccugggagaacaccguggucgaccucgaguccaacggcaagccccagaaggccggcagcaacaacuccaacaagagccugcaguccaccggguucaccgccggccugacguacagccagcucaugacccugaaggacgcgaugcugcagcuggacccgaacgccaagaccuggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugacggaccuguucgccgcgcagcccggccucaccagcgccgucaucgacacccugccccggaacauggugaucacgugccagggcagcgacgacauccgcaagcugcucgagucccaggggcgcaaggacaucaagcugaucgacaucgcccugagcaagaucgacucccggaaguacgagaacgccgucugggaccaguacaaggaccucugccacaugcacaccggcgugguggucgagaagaagaagcgcgggggcaaggaggagaucacgccccacugcgcccugauggacugcaucauguucgacgcggccgugagcgggggccugaacgccuccgugcuccgggccguccugccgcgcgacaugguguuccggaccagcacgccccgcgugguccuguga

SEQ ID NO: 1020 - RNA, 1710 nt, Artificial Sequence
  derived and/or modified CDS sequence (opt1) from Lassa virus__AIT17359__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccauccuccgcgugggcacccugaccagcgacgaccugcucauccuggccgccgaccuggagaagcucaagagcaaggucacccggaccgagcgcccccuguccgccgggguguacaugggcaaccugagcucccagcagcucgaccagcggcgcgcgcugcugaacaugcucgggaugagcggcuccaaccagggcgcccgggccgggcgcgacggcgugguccgggugugggacgugaagaacgccgagcugcugaacaaccaguucgggacgaugccgagccucacccuggcgugccugaccaagcagggccaggucgaccucaacgacgccgugcaggcccugaccgaccuggggcucaucuacacggccaaguaccccaacaccuccgaccuggaccgccugacccagagccaccccauccucaacaugaucgacaccaagaaguccagccugaacaucagcggcuacaacuucucccugggcgccgcggugaaggccggggccugcaugcucgacggcgggaacaugcuggagacgaucaaggucagcccccagaccauggacggcauccugaaguccauccucaaggugaagaaggcccugggcauguucaucagcgacaccccgggggagcggaaccccuacgagaacauccuguacaagaucugccucuccggcgacggguggcccuacaucgccagccgcaccuccaucacgggccgggcgugggagaacaccguggucgaccuggagagcgacgagaagccccagaaggccggguccaacagcuccaacaagagccugcaguccgccggcuucaccgccggccucaccuacagccagcugaugacgcugaaggacgccaugcugcagcucgacccgaacgcgaagaccuggauggacaucgaggggcgccccgaggaccccguggagaucgcccuguaccagcccuccagcggcugcuacauccacuucuuccgggagccgaccgaccugaagcaguucaagcaggacgccaaguacucccacgggaucgacgugaccgaccucuucgccgcccagcccggccugacgagcgcggucaucgacgcccugccccgcaacauggugaucacgugccaggggagcgacgacauccgcaagcuccuggagucccagggccggaaggacaucaagcugaucgacaucgcccucagcaagaccgacucccgcaaguacgagaacgccgugugggaccaguacaaggaccugugccacaugcacaccggcaucgucguggagaagaagaagcgcgggggcaaggaggagaucaccccgcacugcgcgcugauggacugcaucauguucgacgccgccgucagcgggggccucaacgccuccgugcugcgggccgugcugccccgggacauggucuuccgcaccagcacgccccggguggugcucuga

SEQ ID NO: 1021 - RNA, 1710 nt, Artificial Sequence
  derived and/or modified CDS sequence (opt1) from Lassa virus__AIT17361__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccuccgacgaccugcucgugcuggccgccgaccuggagaagcucaagagcaaggugacccggaccgagcgcccccuguccgccggggucuacaugggcaaccugagcucccagcagcucgaccagcggcgcgcgcugcugaacaugaucgggaugagcggcggcaaccagggggcccgggccggccgcgacgggguggugcggaucugggacgucaagaacgccgagcuccugaacaaccaguucggcacgaugccgucccugacccucgcgugccugaccaagcagggccagguggaccugaacgacgugguccaggcccucaccgaccuggggcugaucuacacggccaaguaccccaacaccagcgaccucgaccgccugacccagucccaccccauccugaacaugaucgacaccaagaaguccagccucaacaucagcggcuacaacuucagccugggggccgccgugaaggcgggcgccugcaugcuggacgggggcaacaugcucgagacgaucaaggugagcccccagaccauggacggcauccucaagagcauccugaaggucaagaaggcccuggggauguucaucuccgacaccccgggcgagcggaaccccuacgagaacauccuguacaagaucugccugagcggggacggcuggcccuacaucgccucccgcaccagcaucacggggcgggccugggagaacaccaucguggaccucgaguccgacggcaagccccagaagaccaacaacaccaacagcaacaagucccugcagagcgcgggcuucgccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgucacggaccuguucgccgcccagcccgggcucaccuccgccgugaucgacacccugccccgcaacauggugaucacgugccagggcagcgaggacauccgccggcugcucgagucccagggccgcaaggacaucaagcugaucgacaucgcgcugagcaagaccgacagccggaaguacgagaacgccgucugggaccaguacaaggaccucugccacaugcacaccgggguggucguggagaagaagaagaagggcgggaaggaggagaucacgccccacugcgcccugauggacugcaucauguucgacgccgcgguguccggcgggcugaacaccagcguccuccgcgccgugcugccgcgggacaugguguuccgcaccuccacgccccgggucgugcuguga

SEQ ID NO: 1022 - RNA, 1710 nt, Artificial Sequence
  derived and/or modified CDS sequence (opt1) from Lassa virus__AIT17365__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccaggccgggcgggacggcgugguccgcgugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgcgucccggaccagcaucaccggccgcgccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugaccgaccuguucgccgcgcagcccggccucaccagcgccgucaucgacgcccugccccggaacauggugaucacgugccagggcuccgacgacauccgcaagcuguucgagagccaggggcgcaaggacaucaagcucaucgacaucgcccugagcaagaccgacucccggaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgcgacauggucuuccggaccagcacgccccgcguggugcuguga

SEQ ID NO: 1023 - RNA, 1710 nt, Artificial Sequence
  derived and/or modified CDS sequence (opt1) from Lassa virus__AIT17371__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccaggccgggcgggacggcgugguccgcgugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccggcugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgcgucccggaccagcaucaccggccgcgccugggagaacacgguggucgaccucgaguccgacgggaagccccagaaggccggcagcaacuccagcaacaagucccugcagagcgccggcuucaccgccgggcugaccuacucccagcucaugacccugaaggacgcgaugcugcagcuggacccgaacgccaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccgcgcagcccgggcucaccuccgccgucaucgacgcccugccccggaacauggugaucacgugccagggcagcgacgacauccgcaagcuguucgagagccagggccgcaaggacaucaagcucaucgacaucgcccuguccaagaccgacagccggaaguacgagaacgcggugugggaccaguacaaggaccugugccacaugcacaccgggaucgucguggagaagaagaagcgcggcgggaaggaggagaucacgccccacugcgcccucauggacugcaucauguucgacgccgccgucuccggcgggcugaacaccagcgugcugcgggccgugcucccgcgcgacauggucuuccggaccuccacgccccgcguggugcuguga

SEQ ID NO: 1024 - RNA, 1710 nt, Artificial Sequence
  derived and/or modified CDS sequence (opt1) from Lassa virus__AIT17379__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacccugaccagcgacgaccugcucauccuggccgccgaccuggagaagcucaagagcaaggugacccggaccgagcgcccccuguccgccgggguguacaugggcaaccugagcucccagcagcucgaccagcggcgcgcgcugcugaacaugaucgggaugagcuccggcaaccggggcgcccaggccgggcgcgacggcgucgugcgggugugggacgucaagaacgccgagcuccugaacaaccaguucgggacgaugccgagccugacccucgcgugccugaccaagcagggccagguggaccugaacgacgccgugcaggcccucaccgaccuggggcugaucuacacggccaaguaccccaacaccuccgaccucgaccgccugacccagagccaccccauccugaacauggucgacaccaagaaguccagccucaacaucagcggcuacaacuucucccugggcgccgcggugaaggccggggccugcaugcuggacggcgggaacaugcucgagacgaucaaggugagcccccagaccauggacggcauccugaaguccauccugaaggucaagaaggcccucggcauguucaucagcgacaccccgggggagcggaaccccuacgagaacauccuguacaagaucugccuguccggcgacggguggcccuacaucgccagccgcaccuccaucacgggccgggcgugggagaacaccgugguggaccucgagagcgacgggaagccccagaaggccggcuccaacaacagcaacaagucccugcagagcgccggcuucgccgccgggcugaccuacucccagcucaugacccugaaggacgcgaugcugcagcuggacccgaacgccaagacguggauggacaucgagggccgccccgaggaccccgucgagaucgcccucuaccagcccagcuccgggugcuacauccacuucuuccgggagccgaccgaccugaagcaguucaagcaggacgccaaguacagccacggcaucgacgugaccgaccuguucgccgcgcagcccgggcucaccuccgccgugaucgacgcccugccccgcaacauggucaucacgugccagggcagcgacgacauccgcaagcugcucgagagccagggccggaaggacaucaagcugaucgacaucgcccuguccaagaccgacagccgcaaguacgagaacgcggugugggaccaguacaaggaccucugccacaugcacaccgggaucgucguggagaagaagaagcggggcgggaaggaggagaucacgccccacugcgcccugauggacugcaucauguucgacgccgccguguccggcgggcugaacaccagcguccuccgcgccgugcugccgcgggacaugguguuccgcaccuccacgccccgggucgugcuguga

SEQ ID NO: 1025 - RNA, 1710 nt, Artificial Sequence
  derived and/or modified CDS sequence (opt1) from Lassa virus__AIT17381__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacagcgaccugaagcgccugcgggaccucaaccaggccgucaacaaccugguggagcugaaguccacccagcagaaguccgugcuccgcgucggcacgcugaccagcgacgaccugcucgugcuggccgccgaccuggagaagcucaagagcaaggugacccggaccgagcgcccccuguccgccggggucuacaugggcaaccugagcucccagcagcucgaccagcggcgcgcgcugcugagcaugaucgggauguccggcggcaaccagggggcccgggccggccgcgacgggguggugcggaucugggacgucaagaacgccgagcuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaagaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaaggcccucgggauguucaucagcgacaccccgggcgagcggaaccccuacgagaacauccuguacaagaucugccuguccggggacggcuggcccuacaucgccagccgcaccuccaucacggggcgggccugggagaacaccaucguggaccucgagagcgacggcaagccccagaagaccuccaacaccaacagcaacaagucccugcagagcgcgggcuucgccgccgggcugacguacucccagcucaugacccugaaggacgccaugcugcagcuggacccgaacgccaagaccuggauggacaucgagggccgccccgaggaccccguggagaucgcgcucuaccagcccagcuccgggugcuacauccacuucuuccgggagccgaccgaccugaagcaguucaagcaggacgccaaguacagccacggcaucgacgucacggaccuguucgccgcccagcccgggcucaccuccgccgugaucgacgcgcugccccgcaacauggugaucacgugccagggcagcgaggacauccgcaagcugcucgagagccagggccggaaggacaucaagcugaucgacaucgcccuguccaagaccgacagccgcaaguacgagaacgccgucugggaccaguacaaggaccucugccacaugcacaccgggguggucguggagaagaagaagaagggcgggaaggaggagaucaccccgcacugcgcccugauggacugcaucauguucgacgcggccguguccggcgggcugaacaccagcguccuccgggccgugcugccccgcgacaugguguuccggaccuccacgccccgcgucgugcuguga

SEQ ID NO: 1026 - RNA, 1710 nt, Artificial Sequence
  derived and/or modified CDS sequence (opt1) from Lassa virus__AIT17389__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacggcgaccugaagcgccugcgggaccucaaccaggccgucaacaaccugguggagcugaaguccacccagcagaaguccgugcuccgcgucgggacccugaccagcgacgaccugcucauccuggccgccgaccuggagaagcucaaguccaaggugacccggaccgagcgcccccugagcgccggcguguacauggggaaccuguccagccagcagcucgaccagcggcgcgcgcugcugaacaugaucggcauguccggcgggaaccagggcgcccggacggggaaggacggcgucgugcgcaucugggacgugaagaacgccgaccuccugaacaaccaguucgggaccaugccgagccugacccucgccugccugaccaagcagggccaggucgaccugaacgacguggugcaggcgcucacggaccugggccugaucuacaccgccaaguaccccaacaccuccgaccucgaccggcugacccagagccaccccauccugaacaugaucgacacguccaagagcagccucaacaucuccggguacaacuucagccugggcgccgccgucaaggccggggcgugcaugcuggacggcggcaacaugcucgagaccaucaaggugagcccccagaccauggacgggauccucaagagcauccugaaggugaagaagucccugggcauguucaucagcgacaccccgggggagcgcaaccccuacgagaacauccuguacaagaucugccuguccggcgacggguggcccuacaucgccagccggacguccaucaccggccgcgccugggagaacaccgucguggaccucgagagcgacggcaagccccagaaggccggguccaacaacagcaacaagucccugcagagcaccggcuucacggccgggcugaccuacucccagcucaugacccugaaggacgcgaugcugcagcuggacccgaacgccaagaccuggauggacaucgagggccggcccgaggaccccguggagaucgcccucuaccagcccagcuccgggugcuacauccacuucuuccgcgagccgacggaccugaagcaguucaagcaggacgccaaguacagccacggcaucgacgucaccgaccuguucgccgcgcagcccggccucaccuccgccgugaucgacacccugccccggaacauggugaucacgugccaggggagcgacgacauccgcaagcugcucgagagccagggccgcaaggacaucaagcugaucgacaucgcccuguccaagaccgacagccggaaguacgagaacgccgucugggaccaguacaaggaccucugccacaugcacaccgggguggucguggagaagaagaagcgcggcgggaaggaggagaucacgccccacugcgcccugauggacugcaucauguucgacgcggccguguccggcggccugaacgucagcgugcuccgggccgugcugccgcgcgacauggucuuccggaccuccacgccccgcguggugcuguga

SEQ ID NO: 1027 - RNA, 1710 nt, Artificial Sequence
  derived and/or modified CDS sequence (opt1) from Lassa virus__AIT17399__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacccugaccagcgacgaccugcucgugcuggccgccgaccuggagaagcucaagagcaaggugauccggaccgagcgcccccuguccagcggggucuacaugggcaaccuguccagccagcagcucgaccagcggcgcgcccugcugaacaugaucgggauguccggcggcaaccagggggcccaggugggccgggacggggugguccgcgugugggacgugaagaacgcggaccuccugaacaaccaguucggcaccaugccgagccugacgcucgccugccugaccaagcaggggcaggucgaccugaacgacguggugcaggcccucaccgaccugggccugaucuacaccgcgaaguaccccaacacguccgaccucgaccggcuggcccagagccaccccauccugaacaugaucgacaccaagaaguccagccucaacaucagcggcuacaacuucucccugggggccgccgucaaggccggcgcgugcaugcuggacgggggcaacaugcucgagaccaucaaggugacgccccagaccauggacggcauccucaagagcauccugaaggugaagaaggcccuggggauguucaucuccgagaccccgggcgagcgcaaccccuacgagaacauccuguacaagaucugccugagcggggacggcuggcccuacaucgccucccggaccagcaucaccgggcgcgccugggagaacacggucguggaccucgaguccgacggcaagccccagaaggccggcaacaacaacagcaacaagucccugcagagcgcgggguucaccgccggccugaccuacucccagcucaugacccugaaggacagcaugcugcagcuggacccgaacgccaagacguggauggacaucgaggggcggcccgaggaccccguggaggucgcccucuaccagcccuccagcggcugcuacauccacuucuuccgcgagccgaccgaccugaagcaguucaagcaggacgccaaguacucccacgggaucgacgugaccgaccuguucgcgacccagcccggccucacgagcgccgucaucgaggcccugccccggaacauggugaucacgugccagggcuccgacgacauccgcaagcugcucgagagccaggggcgcaaggacaucaagcugaucgacaucgcccugaacaagaccgacagccggaaguacgagaacgccgugugggaccaguacaaggaccucugccacaugcacaccggcgucgugguggagaagaagaagcgcgggggcaaggaggagaucacgccccacugcgcgcugauggacugcaucauguucgacgccgccgucuccgggggccugaagacccucgcccugcgggcggugcugccgcgcgacaugguguuccggaccagcacccccaaggucgugcucuga

SEQ ID NO: 1028 - RNA, 1710 nt, Artificial Sequence
  derived and/or modified CDS sequence (opt1) from Lassa virus__AIT17405__NP
augagcguguccaaggaggucaagagcuuccuguggacccagucccuccgccgggagcugagcggcuacugcuccaacaucaagcuccagguggugaaggacgcccaggcccugcugcacgggcuggacuucagcgaggucuccaacgugcagcgccucaugcggaagcagaagcgcgacgacagcgaccugaagcggcugcgcgaccucaaccaggcggugaacaaccuggucgagcugaaguccacccagcagaaguccauccuccgggugggcacccugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcccaggggacccagccgggccgcgacggggugguccgggugugggacgugaagaaccccgaccuccugaacaaccaguucggcaccaugcccagccugacccucgcgugccugacgaagcaggggcaggucgaccugaacgacgccgugcucgcccugaccgaccugggccucaucuacaccgccaaguaccccaacuccagcgaccuggaccgccugucccagagccacccgauccucaacaugguggacaucaagaaguccagccugaacaucagcggcuacaacuucucccugggggcggccgucaaggccggcgccugcaugcucgacgggggcaacaugcuggagaccaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgccagccggaccuccaucguggggcgcgcgugggagaacacgaccguggaccuggagagcgacggcaagccccagaaggucggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgcgaaguacucccacggcaucgacgucgccgaccuguucccggcccagcccggccucaccagcgccgugaucgaggcccugccccggaacauggugcugacgugccaggggagcgacgacaucaagcgccuccuggacucccagggccgccgggacaucaagcugaucgacaucgcgcucagcaaggccgacucccgccgguucgagaacgccgucugggaccagugcaaggaccugugccacaugcacaccggggugguggucgagaagaagaagcgcggcgggaaggaggagaucacgccccacugcgcccugauggacugcaucauguacgacgccgcggugagcggcggccucaacaucccggugcugcgggccguccugccccgcgacaugguguuccggaccuccagccccaaggugguccucuga

SEQ ID NO: 1029 - RNA, 1710 nt, Artificial Sequence
  derived and/or modified CDS sequence (opt1) from Lassa virus__AIT17409__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucaacaaggccgacucccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgccgcggucagcggcgggcucaacauccccgugcugcgggccgugcugccgcgggacauggucuuccgcaccuccagccccaagguggugcucuga

SEQ ID NO: 1030 - RNA, 1710 nt, Artificial Sequence
  derived and/or modified CDS sequence (opt1) from Lassa virus__AIT17413__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacgcgcccggcgagcgcaaccccuacgagaacauccuguacaagaucugccucagcggggacggcuggccguacaucgccucccggaccagcaucgucgggcgcgccugggagaacaccaccguggaccuggaguccgacggcaagccccagaagaugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucuga

SEQ ID NO: 1031 - RNA, 1710 nt, Artificial Sequence
  derived and/or modified CDS sequence (opt1) from Lassa virus__AIT17421__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucagcggcgcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaucaagaaguccagccugaacaucuccggcuacaacuucagccugggcgccgccgugaaggccggggccugcaugcucgacggcgggaacaugcuggagaccaucaaggucacgccccagaccauggacggcauccugaaguccauccucaaggugaagcggagccugggcauguucguguccgacacccccggggagcgcaaccccuacgagaacauccuguacaagaucugccucagcggcgacggguggccguacaucgcgucccggaccagcaucgucggccgcgccugggagaacacgaccguggaccuggaguccgacgggaagccccagaagaugggcagcgccggcuccaacaagagccugcaguccgccggguuccccaccggccucaccuacagccagcugaugacgcugaaggacuccaugaugcagcuggaccccagcgccaagaccuggaucgacaucgaggggcggccggaggaccccguggagaucgcgcucuaccagcccauguccggcugcuacauccacuucuuccgcgagcccaccgaccugaagcaguucaagcaggacgccaaguacagccacgggaucgacgucgccgaccuguucccggcccagcccggccucaccagcgccgugaucgaggcgcugccccggaacaugguccugacgugccagggcuccgacgacaucaagcgccuccuggacagccaggggcgccgggacaucaagcugaucgacaucgcccucuccaaggccgacagccgccgguucgagaacgccgugugggaccagugcaaggaccugugccacaugcacaccggcguggucguggagaagaagaagcgcgggggcaaggaggagaucacgccccacugcgcccugauggacugcaucauguacgacgcggccguguccgggggccucaacaucccgguccugcgggccgugcugccccgcgacaugguguuccggaccagcucccccaaggucgugcucuga

SEQ ID NO: 1032 - RNA, 1710 nt, Artificial Sequence
  derived and/or modified CDS sequence (opt1) from Lassa virus__AIT17425__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagaagucccuggggauguucgugagcgacacccccggcgagcggaaccccuacgagaacauccuguacaagaucugccucagcggggacggcuggccguacaucgcgucccgcaccagcaucgucgggcgggccugggagaacaccaucguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccgucgagaucgcgcucuaccagcccaugagcgggugcuacauccacuucuuccgggagcccaccgaccugaagcaguucaagcaggacgccaaguacucccacggcaucgacguggccgaccuguucccggcccagcccggccucacgagcgccgucaucgaggcgcugccccgcaacauggugcugaccugccaggggagcgacgacaucaagcggcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucuga

SEQ ID NO: 1033 - RNA, 1710 nt, Artificial Sequence
  derived and/or modified CDS sequence (opt1) from Lassa virus__AIT17429__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuacaacuucucccugggggccgccgugaaggccggcgcgugcaugcucgacgggggcaacaugcuggagaccaucaaggucacgccccagaccauggacggcauccucaagagcauccugaaggugaagcggucccuggggauguucgugagcgacgcccccggcgagcgcaaccccuacgagaacauccuguacaagaucugccucuccggggacggcuggccguacaucgccagccggaccuccaucgucgggcgcgccugggagaacaccacgguggaccuggagagcgacggcaagccccagaaggugggcaccgccggguccaacaagagccugcaguccgcgggcuuccccaccgggcucaccuacagccagcugaugacgcugaaggacuccaugaugcagcuggaccccagcgccaagaccuggaucgacaucgagggccggccggaggaccccgucgagaucgcccucuaccagcccauguccgggugcuacauccacuucuuccgcgagcccaccgaccugaagcaguucaagcaggacgccaaguacagccacggcaucgacguggccgaccuguucccggcgcagcccggccucaccuccgccgucaucgaggcccugccccggaacauggugcugacgugccaggggagcgacgacaucaagcgccuccuggacagccagggccgccgggacaucaagcugaucgacaucgcccucuccaaggccgacagccgccgguucgagaacgcggugugggaccagugcaaggaccugugccacaugcacaccggggucgugguggagaagaagaagcgcggcgggaaggaggagaucacgccccacugcgcccugauggacugcaucauguacgacgccgccgucuccggcggccucaacaucccggugcugcgggcggugcugccccgcgacauggucuuccggaccagcucccccaagguggugcucuga

SEQ ID NO: 1034 - RNA, 1710 nt, Artificial Sequence
  derived and/or modified CDS sequence (opt1) from Lassa virus__AIT17431__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuucaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccgccagccccaagguggugcucuga

SEQ ID NO: 1035 - RNA, 1710 nt, Artificial Sequence
  derived and/or modified CDS sequence (opt1) from Lassa virus__AIT17439__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuucaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccgucagcgggugcuacauccacuucuuccgcgagcccacggaccugaagcaguucaagcaggacgccaaguacucccacggcaucgacguggccgaccuguucagcgcccagccgggccucaccagcgccgucaucgaggcgcugccccggaacauggugcugaccugccagggguccgacgacaucaagcgccuccuggacagccagggccgccgggacaucaagcugaucgacaucgcccucuccaaggccgacagccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucuccggcggccucaacauccccguguuccgggccgugcugccgcgcgacauggucuuccggaccagcucccccaagguggugcuguga

SEQ ID NO: 1036 - RNA, 1710 nt, Artificial Sequence
  derived and/or modified CDS sequence (opt1) from Lassa virus__AIT17443__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacgcgcccggcgagcgcaaccccuacgagaacauccuguacaagaucugccucagcggggacggcuggccguacaucgccucccggaccagcaucgucgggcgcgccugggagaacaccaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcgcugauggacugcaucauguacgacgccgccgucagcggcggccucaacaucccggugcugcgcgccgugcugccccgggacauggucuuccgcaccuccagccccaagguggugcucuga

SEQ ID NO: 1037 - RNA, 1710 nt, Artificial Sequence
  derived and/or modified CDS sequence (opt1) from Lassa virus__AIT17447__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacgugaccgaccuguucccggcccagcccggccucaccuccgccgucaucgaggcccugccccgcaacauggugcugacgugccaggggagcgacgacaucaagcggcuccuggacagccagggccgccgcgacaucaagcugaucgacaucgcccucuccaaggcggacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgccgccgucuccggcggccucaacaucccggugcugcgcgcggugcugccccgggacauggucuuccgcaccagcucccccaagguggugcucuga

SEQ ID NO: 1038 - RNA, 1710 nt, Artificial Sequence
  derived and/or modified CDS sequence (opt1) from Lassa virus__AIT17451__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacguggccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaacaucccggugcugcgcgccgugcugccccgggacauggucuuccgcaccagcucccccaagguggugcucuga

SEQ ID NO: 1039 - RNA, 1710 nt, Artificial Sequence
  derived and/or modified CDS sequence (opt1) from Lassa virus__AIT17455__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcuguccaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccagcgccgugaucgaggcgcugccccggaacauggugcugaccugccagggguccgacgacaucaagcgccuccuggacagccagggccgccgggacaucaagcugaucgacaucgcccucuccaaggccgacagccgccgguucgagaacgccgucugggaccagugcaaggaccugugccacaugcacaccggggugguggucgagaagaagaagcgcggcgggaaggaggagaucacgccccacugcgcccugauggacugcaucauguacgacgcggccguguccggcggccucaacaucccggugcugcgggccguccugccccgcgacaugguguuccggaccagcucccccaaggugguccucuga

SEQ ID NO: 1040 - RNA, 1710 nt, Artificial Sequence
  derived and/or modified CDS sequence (opt1) from Lassa virus__AIT17459__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccgucagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucuga

SEQ ID NO: 1041 - RNA, 1710 nt, Artificial Sequence
  derived and/or modified CDS sequence (opt1) from Lassa virus__AIT17463__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcacaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaguccacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaccaugguggacacgaagaaguccagccugaacaucagcggcuucaacuucucccugggcgccgccgugaaggccggggccugcaugcucgacggcgggaacaugcuggagaccaucaaggucacgccccagaccauggacggcauccucaagagcauccugaaggugaagaagucccugggcauguucgugagcgacacccccggggagcggaaccccuacgagaacauccuguacaagaucugccucuccggcgacggguggccguacaucgcgagccgcaccuccaucgucggccgggccugggagaacaccaucguggaccuggagaccgacgggaagccccagaaggugggcacggccggcagcucccgcagccugcaguccgccggguuccccaccggccucaccuacagccagcugaugacccugaaggacuccaugaugcagcuggaccccagcgccaagacguggaucgacaucgaggggcggccggaggaccccgucgagaucgcgcucuaccagcccauguccggcugcuacauccacuucuuccgcgagcccaccgaccugaagcaguucaagcaggacgccaaguacagccacgggaucgacguggccgaccuguucccggcccagcccggccucaccagcgccgucaucgaggcgcugccccggaacauggugcugaccugccagggcuccgacgacaucaagaagcuccuggacagccaggggcgccgcgacaucaagcugaucgacaucgcccucuccaaggccgacagccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgcggccgucuccgggggccucaacaucccggugcugcgggccgugcugccccgggacauggucuuccgcaccagcucccccaagguggugcucuga

SEQ ID NO: 1042 - RNA, 1710 nt, Artificial Sequence
  derived and/or modified CDS sequence (opt1) from Lassa virus__AIT17467__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcacccaggggacccagccgggccgcgacgggguggugcgggucugggacgugaagaaccccgaccuccugaacaaccaguucggcaccaugcccucccugacgcucgcgugccugaccaagcagggccagguggaccugaacgacgccguccucgcccugaccgaccuggggcucaucuacaccgccaaguaccccaacagcuccgaccuggaccgccugagccagagccacccgauccucaacaugguggacacgaagaaguccagccugaacaucuccggcuacaacuucagccugggggcggccgugaaggccggcgccugcaugcucgacgggggcaacaugcuggagaccaucaaggucacgccccagaccauggacggcauccugaaguccauccucaaggugaagaagucccuggggauguucgugagcgacacccccggcgagcggaaccccuacgagaacauccuguacaagaucugccucagcggggacggcuggccguacaucgccucccgcaccagcaucgucgggcgggcgugggagaacaccaccguggaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacguggccgaccuguucccggcccagcccggccucaccagcgccgucaucgaggcccugccccgcaacauggugcugaccugccaggggagcgacgacaucaagcggcuccuggacucccagggccgccgcgacaucaagcugaucgacaucagccucuccaaggcggacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgccgucuccggcggccucaacaucccggugcugcgcgcggugcugccccgggacauggucuuccgcaccagcucccccaagguggugcucuga

SEQ ID NO: 1043 - RNA, 1710 nt, Artificial Sequence
  derived and/or modified CDS sequence (opt1) from Lassa virus__AIT17471__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccacggggagcaacaagucccugcagagcgccggcuuccccaccgggcucaccuacucccagcugaugacccugaaggacagcaugaugcagcuggaccccuccgccaagacguggaucgacaucgagggccggccggaggaccccguggagaucgcccucuaccagcccaugagcgggugcuacauccacuucuuccgcgagcccaccgaccugaagcaguucaagcaggacgcgaaguacucccacggcaucgacgucgccgaccuguucccggcccagcccggccucaccagcgccgugaucgaggcccugccccggaacaugguccugaccugccaggggagcgacgacaucaagaagcuccuggacucccagggccgccgcgacaucaagcugaucgacaucgcgcucagcaaggccgacucccggaaguucgagaacguggugugggaccagugcaaggaccugugccacaugcacacgggggucgugguggagaagaagaagcgcggcgggaaggaggagaucacgccccacugcgcccugauggacugcaucauguacgacgccgccgucagcggcggccucaacaucccggugcugcgggcggugcugccccgcgacauggucuuccggaccuccagccccaagguggugcucuga

SEQ ID NO: 1044 - RNA, 1710 nt, Artificial Sequence
  derived and/or modified CDS sequence (opt1) from Lassa virus__AIT17475__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcgcccagcagcucgagcagcgccgggcgcugcuguccaugaucgggauggugggcggcgcccaggggacgcagccgggccgcgacggggugguccgggugugggacgugaagaaccccgaccuccugaacaaccaguucggcaccaugcccagccugacccucgccugccugaccaagcaggggcaggucgaccugaacgacacggugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccaucuccgggugcuacauccacuucuuccgcgagcccacggaccugaagcaguucaagcaggacgccaaguacagccacggcaucgacgucaccgaccuguucccggcccagcccggccucaccagcgccgugaucgaggcccugccccggaacauggugcugaccugccagggguccgacgacaucaagcgccuccuggacagccagggccgccgggacaucaagaucaucgacaucgcgcuguccaaggccgacagccgccgguucgagaacgccgucugggaccagugcaaggaccucugccacaugcacacgggggugguggucgagaagaagaagcgcggcgggaaggaggagaucacgccccacugcgcccugauggacugcaucauguacgacgccgcgguguccggcggccugaacaucccggugcuccgggccguccugccccgcgacaugguguuccggaccagcucccccaaggugguccuguga

SEQ ID NO: 1045 - RNA, 1710 nt, Artificial Sequence
  derived and/or modified CDS sequence (opt1) from Lassa virus__AIT17479__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccgggugggcacgcugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugucccagagccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccuccgccgugaucgaggcgcugccccggaacauggugcugaccugccaggggagcgacgacaucaagaagcuccuggacagccagggccgcaaggacaucaagcugaucgacaucgcccucuccaaggucgacagccgccgguucgagaacgccgugugggaccagugcaaggaccugugccacaugcacaccgggguggucguggagaagaagaagcgcggcgggaaggaggagaucacgccccacugcgcccugauggacugcaucauguacgacgccgcgguguccggcggccucaacaucccgguccugcgggccgugcugccccgcgacaugguguuccggaccagcucccccaaggucgugcucuga

SEQ ID NO: 1046 - RNA, 1710 nt, Artificial Sequence
  derived and/or modified CDS sequence (opt1) from Lassa virus__AIT17491__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacgcugaccagcgacgaccugcucacccuggccgccgaccuggagaagcucaaguccaaggugauccgcaccgagcggccccugagcuccggcgucuacauggggaaccugagcacgcagcagcucgagcagcgccgggcccugcuguccaugaucggcauggugggcggggcgcgcggcacccagccggggcgggacggcgugguccgcgugugggacgugaagaaccccgaccuccugaacaaccaguucgggaccaugcccagccugacccucgccugccugacgaagcagggccaggucgaccugaacgacguggugcucgcccugaccgaccugggccucaucuacaccgccaaguaccccaacuccagcgaccuggaccggcugucccagagccacccgauccucaacauggucgacaccaagaaguccagccugaacaucagcggguacaacuucucccugggcgcggccgugaaggccggggccugcaugcucgacggcggcaacaugcuggagacgaucaaggugacgccccagaccauggacgggauccucaagagcauccugaaggucaagaagucccugggcauguucgugagcgacacccccggggagcgcaaccccuacgagaacauccuguacaagaucugccucuccggcgacggguggccguacaucgccagccggaccuccaucgugggccgcgcgugggagaacaccaccgucgaccuggagagcgacggcaagccccagaaggugggggccgccggcuccaacaagagccugcaguccgccggguuccccaccggccucacguacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccaccgaccugaagcaguucaagcaggacgccaaguacagccacggcaucgacgugacggaccuguucuccgcccagccggggcucaccagcgccgugaucgaggcccugccccggaacaugguccugaccugccagggcagcgacgacaucaagcgccuccuggacucccaggggcgccgggacaucaagcugaucgacaucgcgcucagcaaggccgacucccgccgguucgagaacgccgugugggaccagugcaaggaccugugccacaugcacaccggcguggucguggagaagaagaagcgcgggggcaaggaggagaucacgccccacugcgcccugauggacugcaucauguacgacgccgcggugagcggcgggcucaacauccccguccugcgggccgugcugccgcgcgacaugguguuccggaccuccagccccaaggucgugcucuga

SEQ ID NO: 1047 - RNA, 1710 nt, Artificial Sequence
  derived and/or modified CDS sequence (opt1) from Lassa virus__AIT17495__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcagagcgcccagccggggcgcgacggcguggugcgggucugggacgugaagaaccccgaccuccugaacaaccaguucgggaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuucaacuucagccugggcgccgccgugaaggccggggcgugcaugcucgacggcgggaacaugcuggagaccaucaaggucacgccccagaccauggacggcauccugaaguccauccucaaggugaagcggagccugggcauguucguguccgacgcccccggggagcgcaaccccuacgagaacauccuguacaagaucugccucagcggcgacggguggccguacaucgccucccggaccagcaucgucggccgcgccugggagaacaccacgguggaccuggaguccgacgggaagccccagaaggugggcaccgccggcagcaacaagucccugcagagcgcgggguuccccaccggccucaccuacucccagcugaugacgcugaaggacagcaugaugcagcuggaccccuccgccaagaccuggaucgacaucgaggggcggccggaggaccccgucgagaucgcccucuaccagcccaugagcggcugcuacauccacuucuuccgcgagcccaccgaccugaagcaguucaagcaggacgccaaguacucccacgggaucgacguggccgaccuguucccggcgcagcccggccucaccagcgccgucaucgaggcccugccccggaacauggugcugacgugccagggcagcgacgacaucaagaagcuccuggacucccaggggcgccgcgacaucaagcugaucgacaucgcccucagcaaggccgacucccggcgcuucgagaacgcggugugggaccagugcaaggaccugugccacaugcacaccggcgucgugguggagaagaagaagcgcgggggcaaggaggagaucacgccccacugcgcccugauggacugcaucauguacgacgccgccgucagcgggggccucaacaucccggugcugcgggcggugcugccccgggacauggucuuccgcaccuccagccccaagguggugcucuga

SEQ ID NO: 1048 - RNA, 1710 nt, Artificial Sequence
  derived and/or modified CDS sequence (opt1) from Lassa virus__AIT17499__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaucaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcgccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacgugaagcgccuccuggacucccagggccgccgggacaucaagcugaucgacaucgcccucagcaaggccgacucccgccgguucgagaacgccgucugggaccagugcaaggaccugugccacaugcacaccggggugguggucgagaagaagaagcgcggcgggaaggaggagaucacgccccacugcgcgcugauggacugcaucauguacgacgccgccgugagcggcggccucaacaucccggugcugcgggccguccugccccgcgacaugguguuccggaccuccagccccaaggugguccucuga

SEQ ID NO: 1049 - RNA, 1710 nt, Artificial Sequence
  derived and/or modified CDS sequence (opt1) from Lassa virus__AIT17503__NP
augagcuccagcaaggaggugaaguccuuccuguggacccagagccuccgccgggagcuguccggcuacugcagcuccaucaagcugcaggucgugaaggacgcccaggcccuccugcacgggcuggacuucagcgagguguccaacguccagcgccucaugcggaagcagaagcgcgacgacagcgaccugaagcggcugcgcgaccucaaccaggcggugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugagccagucccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacgagcgccgucaucgaggcgcugccccgcaacauggugcugaccugccagggguccgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucuga

SEQ ID NO: 1050 - RNA, 1710 nt, Artificial Sequence
  derived and/or modified CDS sequence (opt1) from Lassa virus__AIT17507__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccaucgacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccgucgagaucgcgcuguaccagcccauguccgggugcuacauccacuucuuccgggagcccacggaccugaagcaguucaagcaggacgccaaguacagccacggcaucgacguggccgaccucuucccggcccagcccggccugaccuccgccgucaucgaggcgcugccccgcaacauggugcugaccugccaggggagcgacgacaucaagcggcuccuggacagccagggccgccgcgacaucaagcucaucgacaucgcccuguccaagguggacagccggcgcuucgagaacgccgucugggaccagugcaaggaccugugccacaugcacaccggggugguggucgagaagaagaagcggggcgggaaggaggagaucacgccccacugcgcccucauggacugcaucauguacgacgccgcgguguccggcggccugaacaucccggugcugcgcgccguccucccccgggacaugguguuccgcaccagcucccccaaggugguccuguga

SEQ ID NO: 1051 - RNA, 1710 nt, Artificial Sequence
  derived and/or modified CDS sequence (opt1) from Lassa virus__AIT17511__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccaucgacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaaggccgacagccggcgcuucgagaacgccgugugggaccagugcaaggaccugugccacaugcacacgggcgucgugguggagaagaagaagcgcgggggcaaggaggagaucacgccccacugcgcccugauggacugcaucauguacgacgccgcggucuccggcgggcucaacauccccgugcugcgggccgugcugccgcgggacauggucuuccgcaccagcucccccaagguggugcucuga

SEQ ID NO: 1052 - RNA, 1710 nt, Artificial Sequence
  derived and/or modified CDS sequence (opt1) from Lassa virus__AIT17515__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcgccgccgggagcuccaagagccugcaguccgccggcuuccccaccgggcucacguacagccagcugaugacccugaaggacuccaugaugcagcuggaccccagcgcgaagaccuggaucgacaucgagggccggccggaggaccccgucgagaucgcccucuaccagcccguguccgggugcuacauccacuucuuccgcgagcccaccgaccugaagcaguucaagcaggacgccaaguacagccacggcaucgacgucgccgaccuguucccggcccagcccggccucacgagcgcggugaucgaggcccugccccggaacauggugcugaccugccagggguccgacgacaucaagcgccuccuggacagccagggccgccgggacaucaagcugaucgacaucgcccucuccaaggccgacagccgccgguucgagaacgccgucugggaccagugcaaggaccugugccacaugcacaccggggugguggucgagaagaagaagcgcggcgggaaggaggagaucacgccccacugcgcgcugauggacugcaucauguacgacgccgccguguccggcggccucaacaucccggugcugcgggccguccugccccgcgacaugguguuccggaccagcucccccaaggugguccucuga

SEQ ID NO: 1053 - RNA, 1710 nt, Artificial Sequence
  derived and/or modified CDS sequence (opt1) from Lassa virus__AIT17519__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuucaacuucucccugggggccgccgugaaggccggcgcgugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgccagccggaccuccaucgucgggcgcgccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgcgaagaccuggaucgacaucgagggccggccggaggaccccgucgagaucgcccucuaccagcccauguccgggugcuacauccacuucuuccgcgagcccaccgaccugaagcaguucaagcaggacgccaaguacagccacggcaucgacguggccgaccuguucccggcccagcccggccucacguccgcggucaucgaggcccugccccggaacauggugcugaccugccaggggagcgacgacaucaagcgccuccuggacagccagggccgccgggacaucaagcugaucgacaucgcccucuccaaggccgacagccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucuccggcggccucaacaucccggugcugcgggccgugcugccccgcgacauggucuuccggaccagcucccccaagguggugcucuga

SEQ ID NO: 1054 - RNA, 1710 nt, Artificial Sequence
  derived and/or modified CDS sequence (opt1) from Lassa virus__AIT17525__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacccugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccggcugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcgcagccuggggauguucgucuccgacacccccggcgagcggaaccccuacgagaacauccuguacaagaucugccucagcggggacggcuggccguacaucgcgucccgcaccagcaucguggggcgggccugggagaacaccaccguggaccuggaguccgacggcaagccccagaaggucggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccacggaccugaagcaguucaagcaggacgccaaguacucccacggcaucgacgucgccgaccuguucccgacccagcccggccucaccagcgccgugaucgaggcccugccccgcaacauggugcugaccugccaggggagcgacgacaucaagcgccuccuggacucccagggccggcgcgacaucaagcugaucgacaucgcgcucagcaaggccgacucccggaaguucgagaacgccgucugggaccagugcaaggaccugugccacaugcacacgggggugguggucgagaagaagaagcgcggcgggaaggaggagaucacgccccacugcgcccugauggacugcaucauguacgacgccgcggugagcggcggccucaacaucccggugcugcgggccguccugccccgcgacaugguguuccggaccuccagccccaaggugguccucuga

SEQ ID NO: 1055 - RNA, 1710 nt, Artificial Sequence
  derived and/or modified CDS sequence (opt1) from Lassa virus__AIT17533__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgaggugaacaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcacccaggggacccagccgggccgcgacggggucgugcgggugugggacgucaagaaccccgaccuccugaacaaccaguucggcaccaugcccucccugacgcucgccugccugaccaagcagggccagguggaccugaacgacgccgugcucgcccugaccgaccuggggcucaucuacaccgcgaaguaccccaacagcuccgaccuggaccgccugagccagucccacccgauccucaacauggucgacacgaagaaguccagccugaacaucagcggcuacaacuucagccugggggccgccgugaaggccggcgccugcaugcucgacgggggcaacaugcuggagaccaucaaggugacgccccagaccauggacggcauccugaaguccauccucaaggucaagcggagccuggggauguucguguccgacacccccggcgagcgcaaccccuacgagaacauccuguacaagaucugccucagcggggacggcuggccguacaucgcgucccggaccagcaucguggggcgcgccugggagaacaccaccgucgaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccggccggaggaccccguggagaucgcgcucuaccagcccaugagcgggugcuacauccacuucuuccgcgagcccaccgaccugaagcaguucaagcaggacgccaaguacucccacggcaucgacgucgccgaccuguucccggcccagcccggccucaccagcgccgugaucgaggcgcugccccggaacaugguccugaccugccagggguccgacgacaucaagaagcuccuggacagccagggccgccgcgacaucaagcugaucgacaucagccucuccaagaucgacagccggaaguucgagaacgccgugugggaccagugcaaggaccugugccacaugcacacggggguggucguggagaagaagaagcgcggcgggaaggaggagaucacgccccacugcgcccugauggacugcaucauguucgacgccgccguguccggcggccucaacaucccgguccugcgggcggugcugccccgcgacaugguguuccggaccagcucccccaaggucgugcucuga

SEQ ID NO: 1056 - RNA, 1710 nt, Artificial Sequence
  derived and/or modified CDS sequence (opt1) from Lassa virus__AIT17539__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacgcugaccagcgacgaccugcucauccuggccgccgaccuggagaagcucaaguccaaggugauccgcaccgagcggccccugagcuccggcgucuacauggggaaccugagcacccagcagcucgagcagcgcaaggcccugcuguccaugaucggcauggugggcggggcgcagggcacgcagccggggcgggacggcgugguccgcgugugggacgugaagaaccccgaccuccugaacaaccaguucgggaccaugcccagccugacccucgccugccugaccaagcagggccaggucgaccugaacgacgccgugcucgcccugacggaccugggccucaucuacaccgcgaaguaccccaacuccagcgaccuggaccggcugucccagagccacccgauccucaacaugguggacaccaagaaguccagccugaacaucagcggguacaacuucucccugggcgccgccgucaaggccggggccugcaugcucgacggcggcaacaugcuggagaccaucaaggugacgccccagaccauggacgggauccucaagagcauccugaaggugaagcgcucccugggcauguucgucagcgacacccccggggagcggaaccccuacgagaacauccuguacaagaucugccucuccggcgacggguggccguacaucgcgagccgcaccuccaucgugggccgggccugggagaacacgaccguggaccuggagagcgacggcaagccccagaaggucggguccgccggcagcaacaagucccugcagagcgccggguuccccaccggccucaccuacucccagcugaugacgcugaaggacagcaugaugcagcuggaccccuccgccaagaccuggaucgacaucgaggggcgcccggaggaccccguggagaucgcgcucuaccagcccaugagcggcugcuacauccacuucuuccgggagcccaccgaccugaagcaguucaagcaggacgccaaguacucccacggcaucgacgucaccgaccuguucagcgcccagccggggcucacgagcgccgugaucgaggcccugccccgcaacauggugcugaccugccagggcuccgacgacaucaagaagcuccuggacagccaggggcggcgcgacaucaagcugaucgacaucucccucggcaaggcggacagccgccgguucgagaacgccgucugggaccagugcaaggaccugugccacaugcacaccggggugguggucgagaagaagaagcgcggcggcaaggaggagaucacgccccacugcgcccugauggacugcaucauguucgacgccgccguguccgggggccucaacauccccauccugcgggcggugcugccgcgcgacauggucuuccggaccagcucccccaagguggugcucuga

SEQ ID NO: 1057 - RNA, 1710 nt, Artificial Sequence
  derived and/or modified CDS sequence (opt1) from Lassa virus__AIT17541__NP
augagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccguccugcggguggggacccugagcuccgacgaccugcucacccuggccgccgaccuggagaagcucaagagcaaggugauccgcaccgagcggccccuguccagcggcgucuacauggggaaccuguccagccagcagcucgaccagcgccgggcccugcugaacaugaucggcaugaccuccgaccgccagggcgcgagcacggggcgggacggcaucgugcgcgugugggacgucaagaacgccgagcuccugaacaaccaguucgggaccgugccgucccugacccucgccugccugaccaagcagggccagguggaccugaacgacgccguccaggcgcucacggaccuggggcugaucuacaccgccaaguaccccaacagcagcgaccucgaccggcugucccagagccaccccauccugaacaugaucgacaccaagaaguccagccucaacaucuccggcuacaacuucagccugggcgccgccgugaaggccggggcgugcaugcuggacggcgggaacaugcucgagaccaucaaggugagcccccagacgauggacggcauccucaagagcauccugaaggucaagcgcucccugggcauguucgugagcgacaucccgggggagcggaaccccuacgagaacauccuguacaagaucugccuguccggcgacggguggcccuacaucgccagccgcaccuccaucaccggccgggccugggagaacaccaucguggaccucgagagcgacuccaagccccagaagccggggaacagcggcuccaaccgcagccugcaguccgccggcuuccccgccgggcugacguacagccagcucaugacccugaaggacagcaugcugcagcuggaccccaacgcgaagaccuggauggacaucgagggccggcccgacgacccggucgagaucgcccucuaccagcccuccagcgggugcuacauccacuucuuccgcgagcccaccgaccugaagcaguucaagcaggacgccaaguacucccacggcaucgacgugggggaccuguucgccgcccagcccggccucacgagcgcggugaucgaggcccugccgcgcaacauggucaucacgugccagggcuccgaggacaucaagaagcugcucgagagccaggggcggaaggacaucaagcugguggacaucuccaugagcaagcccgacucccgcaaguucgagaacgccgucugggaccaguacaaggaccugugccacaugcacaccggcaucgugguggagaagaagaagcgcgggggcaaggaggagaucacgccccacugcgcccucauggacugcaucauguucgacgccgcggucgucgggggccuggacgcccggauccugcgggccgugcucccccgcgacaugguguuccggaccagcaccccgaagguggugcuguga

SEQ ID NO: 1058 - RNA, 1710 nt, Artificial Sequence
  derived and/or modified CDS sequence (opt1) from Lassa virus__AIT17545__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccguccuccgggugggcacgcugaccagcgacgaccugcucacccuggccgccgaccuggagaagcucaagagcaaggugauccgcaccgagcggccccuguccagcggggucuacaugggcaaccuguccacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugucccagagccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgcgagccgcaccuccaucguggggcgggccugggagaacaccaccguggaccuggagagcgacggcaagccccagaaggucggcaucgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccguggagaucgcgcucuaccagcccauguccgggugcuacauccacuucuuccgggagcccaccgaccugaagcaguucaagcaggacgccaaguacagccacggcaucgacgucgccgaccuguucuccgcccagccgggccucacgagcgccgugaucgaggcgcugccccgcaacauggugcugaccugccaggggagcgacgacaucaagcggcuccuggacucccagggccgccgcgacaucaagcugaucgacaucgcccucagcaaggccgacucccggaaguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucgacauccccgugcugcgggccguccugccgcgcgacaugguguuccggaccuccagccccaaggugguccucuga

SEQ ID NO: 1059 - RNA, 1710 nt, Artificial Sequence
  derived and/or modified CDS sequence (opt1) from Lassa virus__AIT17549__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgucgugcucgcccugaccgaccuggggcucaucuacaccgccaaguaccccaacuccagcgaccuggaccgccugucccagagccacccgauccucaacaugguggacaccaagaaguccagccugaacaucagcggcuacaacuucucccugggggcggccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgccagccgcaccuccaucguggggcgggcgugggagaacaccaccguggaccuggagagcgacggcaagccccagaaggucggcaccgugggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcccucuaccagcccauguccgggugcuacauccacuucuuccgggagcccacggaccugaagcaguucaagcaggacgccaaguacagccacggcaucgacguggcggaccuguucccggcccagcccggccucaccuccgccgugaucgaggcccugccccgcaacaugguccugaccugccaggggagcgacgacaucaagaagcuccuggacagccagggccggcgcgacaucaagcugaucgacaucgcccucuccaaggcggacagccgcaaguucgagaacgccgugugggaccagugcaaggaccugugccacaugcacaccgggguggucguggagaagaagaagcggggcgggaaggaggagaucacgccccacugcgcccugauggacugcaucauguacgacgccgccguguccggcggccucaacaucccgguccugcgcgcggugcugccccgggacaugguguuccgcaccagcucccccaaggucgugcucuga

SEQ ID NO: 1060 - RNA, 1710 nt, Artificial Sequence
  derived and/or modified CDS sequence (opt1) from Lassa virus__AIT17553__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaagaugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccguggagaucgcgcucuaccagcccaugagcgggugcuacauccacuucuuccgcgagcccacggaccugaagcaguucaagcaggacgccaaguacucccacggcaucgacgucgccgaccuguucccggcccagcccggccucaccagcgccgugaucgaggcgcugccccggaacaugguccugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccgggguggucguggagaagaagaagcggggcgggaaggaggagaucacgccccacugcgcccugauggacugcaucauguacgacgcggccgugagcggcggccucaacaucccgguccugcgcgccgugcugccccgggacaugguguuccgcaccuccagccccaaggucgugcucuga

SEQ ID NO: 1061 - RNA, 1710 nt, Artificial Sequence
  derived and/or modified CDS sequence (opt1) from Lassa virus__AIT17561__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccaucgacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgucggguccaacaagagccugcaguccgccggcuuccccacggggcucaccuacagccagcugaugacccugaaggacuccaugaugcagcuggaccccagcgccaagaccuggaucgacaucgagggccgcccggaggaccccguggagaucgcccucuaccagcccauguccgggugcuacauccacuucuuccgggagcccacggaccugaagcaguucaagcaggacgcgaaguacagccacggcaucgacgucgccgaccuguucccggcccagcccggccucaccuccgccgugaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgucugggaccagugcaaggaccugugccacaugcacaccggggugguggucgagaagaagcggcgcggcgggaaggaggagaucacgccccacugcgcccugauggacugcaucauguacgacgccgcgguguccggcggccucaacaucccggugcugcgggccguccugccccgcgacaugguguuccggaccagcucccccaaggugguccucuga

SEQ ID NO: 1062 - RNA, 1710 nt, Artificial Sequence
  derived and/or modified CDS sequence (opt1) from Lassa virus__AIT17565__NP
augagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaaggccgacucccgcaaguucgagaacgccgugugggaccagugcaaggaccugugccacaugcacaccgggguggucguggagaagaagaagcggggcgggaaggaggagaucacgccccacugcgcgcugauggacugcaucauguacgacgccgccgugagcggcggccucaacaucccgguccugcgcgccgugcugccccgggacaugguguuccgcaccuccagccccaaggucgugcucuga

SEQ ID NO: 1063 - RNA, 1710 nt, Artificial Sequence
  derived and/or modified CDS sequence (opt1) from Lassa virus__AIT17569__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccgcccggaggaccccgucgagaucgcccucuaccagcccauguccgggugcuacauccacuucuuccgggagcccaccgaccugaagcaguucaagcaggacgcgaaguacagccacggcaucgacguggccgaccuguucccggcccagcccggccucaccuccgccgucaucgaggcccugccccgcaacauggugcugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacacgggggucgugguggagaagaagaagcggggcgggaaggaggagaucacgccccacugcgcccugauggacugcaucauguacgacgccgcggucuccggcggccucaaccugccggugcugcgcgccgugcucccccgggacauggucuuccgcaccagcucccccaagguggugcuguga

SEQ ID NO: 1064 - RNA, 1710 nt, Artificial Sequence
  derived and/or modified CDS sequence (opt1) from Lassa virus__AIT17573__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacaucgccgaccuguucccggcccagcccggccucaccuccgccgugaucgaggcgcugccccgcaacaugguccugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgcggccguguccggcggccucaacaucccgguccugcgcgccgugcugccccgggacaugguguuccgcaccagcucccccaaggucgugcucuga

SEQ ID NO: 1065 - RNA, 1710 nt, Artificial Sequence
  derived and/or modified CDS sequence (opt1) from Lassa virus__AIT17577__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgccgggcgcgccugggagaacaccaccgucgaccuggaguccgacggcaagccccagaaggugggcgccgccgggagcaacaagucccugcagagcgcgggcuuccccaccgggcucacguacucccagcugaugacccugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcgcagcccggccucacgagcgccgugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgcggugugggaccagugccgcgaccugugccacaugcacaccgggguggucguggagaagaagaagcggggcgggaaggaggagaucacgccccacugcgcccugauggacugcaucauguacgacgccgccgugagcggcggccucaacaucccgguccugcgcgcggugcugccccgggacaugguguuccgcaccuccagccccaaggucgugcucuga

SEQ ID NO: 1066 - RNA, 1710 nt, Artificial Sequence
  derived and/or modified CDS sequence (opt1) from Lassa virus__AIT17581__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcgcccagcagcucgagcagcgccggacgcugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacguggugcucgcccugaccgaccugggccucaucuacaccgccaaguaccccaacagcuccgaccuggaccgccugagccagagccacccgauccucuccauggucgacaccaagaaguccagccugaacaucagcggcuacaacuucucccugggggcggccgugaaggccggcgccugcaugcucgacgggggcaacaugcuggagacgaucaaggugacgccccagaccauggacggcauccucaagagcauccugaaggucaagaagucccuggggauguucgugagcgacacccccggcgagcggaaccccuacgagaacauccuguacaagaucugccucuccggggacggcuggccguacaucgccagccgcaccuccaucguggggcgggcgugggagaacaccaccgucgaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcccucuaccagcccauguccgggugcuacauccacuucuuccgggagcccacggaccugaagcaguucaagcaggacgcgaaguacagccacggcaucgacgugaccgaccuguucccggcccagcccggccucaccagcgccgugaucgaggcccugccccgcaacaugguccugaccugccagggguccgacgacaucaagcggcuccuggacagccagggccgccgcgacaucaagcugaucgacaucgcccucuccaaggcggacagccggcgcuucgagaacgccgugugggaccagugcaaggaccugugccacaugcacacggggguggucguggagaagaagaagcggggcgggaaggaggagaucacgccccacugcgcccugauggacugcaucauguacgacgccgccguguccggcggccucaacaucccgguccugcgcgcggugcugccccgggacaugguguuccgcaccagcucccccaaggucgugcucuga

SEQ ID NO: 1067 - RNA, 1710 nt, Artificial Sequence
  derived and/or modified CDS sequence (opt1) from Lassa virus__AIT17589__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuacaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccaccgggagcaacaagucccugcagagcgccggcuuccccacggggcucaccuacucccagcugaugacccugaaggacagcaugaugcagcuggaccccuccgccaagaccuggaucgacaucgagggccggccggaggaccccgucgagaucgcgcucuaccagcccaugagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagaagcuccuggacucccagggccgccgcgacaucaagcugaucgacaucgcccucagcaaggccgacucccggaaguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucuga

SEQ ID NO: 1068 - RNA, 1710 nt, Artificial Sequence
  derived and/or modified CDS sequence (opt1) from Lassa virus__AIT17593__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacggcgaccugaagcggcugcgcgaccucaaccaggccgugaacaaccugguggagcugaaguccacccagcagaaguccauccuccgggucgggacgcugaccagcgacgaccugcucacccuggccgccgaccuggagaagcucaagagcaaggugauccgcaccgagcggccccuguccagcggcguguacauggggaaccuguccagccagcagcucgagcagcgccgggcccugcugaacaugaucggcauggucggcggggcgcagggcacgcagccggggcgcgacggcguggugcgggucugggacgugaagaaccccgaccuccugaacaaccaguucgggaccaugcccucccugacccucgccugccugaccaagcagggccagguggaccugaacgacgccguccucgcccugacggaccugggccucaucuacaccgcgaaguaccccaacagcuccgaccuggaccgccugagccagagccacccgauccucaacaugguggacaccaagaaguccagccugaacaucuccggguacaacuucagccugggcgccgccgugaaggccggggccugcaugcucgacggcggcaacaugcuggagaccaucaaggucacgccccagaccauggacgggauccugaaguccauccucaaggugaagcggagccugggcauguucguguccgacacccccggggagcgcaaccccuacgagaacauccuguacaagaucugccucagcggcgacggguggccguacaucgcgucccggaccagcaucgucggccgcgccugggagaacacgaccguggaccuggaguccgacggcaagccccagaaggugggggccgccggcagcaccaagucccugcagagcgccggguuccccaccggccucacguacucccagcugaugacccugaaggacagcaugaugcagcuggaccccuccgcgaagaccuggaucgacaucgaggggcggccggaggaccccgucgagaucgcccucuaccagcccaugagcggcugcuacauccacuucuuccgcgagcccaccgaccugaagcaguucaagcaggacgccaaguacucccacggcaucgacguggccgaccuguucccggcccagcccgggcucacgagcgcggucaucgaggcccugccccggaacauggugcugaccugccagggcagcgacgacaucaagcgccuccuggacucccaggggcgccgggacaucaagcugaucgacaucgcccucagcaagguggacucccgccgguucgagaacgccgucugggaccagugcaaggaccugugccacaugcacaccggcgugguggucgagaagaagaagcgcgggggcaaggaggagaucacgccccacugcgcccugauggacugcaucauguacgacgcggccgugagcggcgggcucaacaucccggugcugcgggccguccugccccgcgacaugguguuccggaccuccagccccaaggugguccucuga

SEQ ID NO: 1069 - RNA, 1710 nt, Artificial Sequence
  derived and/or modified CDS sequence (opt1) from Lassa virus__AIT17605__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagagccacccgauccucaacauggucgacaccaagaaguccagccugaacaucuccggcuacaacuucagccugggggccgccgugaaggccggcgcgugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggccugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgcgaagaccuggaucgacaucgagggccgcccggaggaccccguggagaucgcccucuaccagcccaugagcgggugcuacauccacuucuuccgggagcccacggaccugaagcaguucaagcaggacgccaaguacucccacggcaucgacgucgccgaccuguucagcgcccagccgggccucaccagcgcggugaucgaggcccugccccgcaacaugguccugaccugccagggguccgacgacaucaagcggcuccuggacagccagggccgccgcgacaucaagcugaucgacaucgcccucuccaaggccgacagccggcgcuucgagaacgccgugugggaccagugcaaggaccugugccacaugcacaccgggguggucguggagaagaagaagcggggcgggaaggaggagaucacgccccacugcgcgcugauggacugcaucauguacgacgccgccguguccggcggccucaacauccccguccugcgcgccgugcugccgcgggacaugguguuccgcaccagcucccccaaggucgugcucuga

SEQ ID NO: 1070 - RNA, 1710 nt, Artificial Sequence
  derived and/or modified CDS sequence (opt1) from Lassa virus__AIT17609__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggcgggcggcgcccaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcgcugaccgaccuggggcucaucuacaccgccaaguaccccaacagcuccgaccuggaccgccugagccagagccacccgauccucaacauggucgacaccaagaaguccagccugaacaucuccggcuacaacuucagccugggggccgccgugaaggccggcgcgugcaugcucgacgggggcaacaugcuggagacgaucaaggugacgccccagaccauggacggcauccugaaguccauccucaaggucaagcggagccuggggauguucguguccgacacccccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcgccgccgggagcaacaagucccugcagagcgcgggcuuccccaccgggcucacguacucccagcugaugacccugaaggacagcaugaugcagcuggaccccuccgccaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcgcagcccggccucacgagcgccgugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgcggugugggaccagugcaaggaccugugccacaugcacaccgggguggucguggagaagaagaagcgcggcgggaaggaggagaucacgccccacugcgcccugauggacugcaucauguacgacgccgccgugagcggcggccucaacaucccgguccugcgggcggugcugccccgcgacaugguguuccggaccuccagccccaaggucgugcucuga

SEQ ID NO: 1071 - RNA, 1710 nt, Artificial Sequence
  derived and/or modified CDS sequence (opt1) from Lassa virus__AIT17613__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccgucgagaucgcgcucuaccagcccauguccgggugcuacauccacuucuuccgcgagcccacggaccugaagcaguucaagcaggacgccaaguacagccacggcaucgacguggccgaccuguucccggcccagcccggccucaccuccgccgucaucgaggcgcugccccggaacauggugcugaccugccaggggagcgacgacaucaagcgccuccuggacagccagggccgccgggacaucaagcugaucgacaucgcccucuccaagaccgacagccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucuccggcggccucaacaucccggugcugcgggccgugcugccccgcgacauggucuuccggaccagcucccccaagguggugcucuga

SEQ ID NO: 1072 - RNA, 1710 nt, Artificial Sequence
  derived and/or modified CDS sequence (opt1) from Lassa virus__AIT17617__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuucaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucagcggcggccucaacaucccggugcugcgggccgugcugccccgcgacauggucuuccggaccuccagccccaagguggugcucuga

SEQ ID NO: 1073 - RNA, 1710 nt, Artificial Sequence
  derived and/or modified CDS sequence (opt1) from Lassa virus__AIT17621__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugaccaacguccagcgccucaugcggaagcagaagcgcgacgacagcgaccugaagcggcugcgcgaccucaaccaggccgugaacaaccugguggagcugaaguccacgcagcagaaguccauccuccgggucggcacccugaccagcgacgaccugcucacccuggccgccgaccuggagaagcucaagagcaaggugauccgcacggagcggccccuguccagcgggguguacaugggcaaccuguccacccagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacgcucgccugccugaccaagcagggccagguggaccugaacgacgccguccucgcccugaccgaccuggggcucaucuacaccgcgaaguaccccaacuccagcgaccuggaccgccugucccagagccacccgauccucaacaugguggacacgaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaucgccggguccaacaagagccugcaguccgccggcuuccccacggggcucaccuacagccagcugaugacccugaaggacuccaugaugcagcuggaccccagcgccaagaccuggaucgacaucgagggccggccggaggaccccgucgagaucgcgcucuaccagcccauguccgggugcuacauccacuucuuccgcgagcccacggaccugaagcaguucaagcaggacgccaaguacagccacggcaucgacguggccgaccuguucccggcccagcccggccucaccuccgccgucaucgaggcgcugccccggaacauggugcugaccugccaggggagcgacgacaucaagcgccuccuggacagccagggccgccgggacaucaagcugaucgacaucgcccucuccaaggccgacagccgcaaguucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucuga

SEQ ID NO: 1074 - RNA, 1710 nt, Artificial Sequence
  derived and/or modified CDS sequence (opt1) from Lassa virus__AIT17625__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacgcugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccggcugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcgcagccuggggauguucgucuccgacacccccggcgagcggaaccccuacgagaacauccuguacaagaucugccucagcggggacggcuggccguacaucgcgucccgcaccagcaucguggggcgggccugggagaacaccaccguggaccuggaguccgacggcaagccccagaaggucggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccacggaccugaagcaguucaagcaggacgccaaguacucccacggcaucgacgucgccgaccuguucccggcccagcccggccucaccagcgccgugaucgaggcgcugccccgcaacauggugcugaccugccaggggagcgacgacaucaagcgccuccuggacucccagggccggcgcgacaucaagcugaucgacaucgcccucagcaaggccgacucccggaaguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucaacaucccggugcugcgggccguccugccccgcgacaugguguuccggaccuccagccccaaggugguccucuga

SEQ ID NO: 1075 - RNA, 1710 nt, Artificial Sequence
  derived and/or modified CDS sequence (opt1) from Lassa virus__AIT17627__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcucccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugagccagucccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacacgaccguggaccuggagagcgacggcaagccccagaaggugggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccgucgagaucgcgcucuaccagcccaugagcgggugcuacauccacuucuuccgcgagcccaccgaccugaagcaguucaagcaggacgccaaguacagccacggcaucgacguggccgaccuguucccggcccagcccggccucaccuccgccgucaucgaggcgcugccccggaacauggugcugacgugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucuga

SEQ ID NO: 1076 - RNA, 1710 nt, Artificial Sequence
  derived and/or modified CDS sequence (opt1) from Lassa virus__AIT17631__NP
augagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccgggguggucguggagaagaagaagcgcggcgggaaggaggagaucacgccccacugcgcgcugauggacugcaucauguacgacgccgccgugagcggcggccucaacaucccgguccugcgggccgugcugccccgcgacaugguguuccggaccuccagccccaaggucgugcucuga

SEQ ID NO: 1077 - RNA, 1710 nt, Artificial Sequence
  derived and/or modified CDS sequence (opt1) from Lassa virus__AIT17635__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacaacgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugaacacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacucccagggccgccgcgacaucaagcugaucgacaucgcccucagcaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucuga

SEQ ID NO: 1078 - RNA, 1710 nt, Artificial Sequence
  derived and/or modified CDS sequence (opt1) from Lassa virus__AIT17639__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaucaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagcggucccuggggauguucgugagcgacacccccggcgagcgcaaccccuacgagaacauccuguacaagaucugccucuccggggacggcuggccguacaucgcgagccggaccuccaucgucgggcgcgccugggagaacacgaccguggaccuggagagcgacggcaagccccagaaggugggcuccgccgggagcaacaagucccugcagagcgccggcuuccccaccgggcucaccuacucccagcugaugacgcugaaggacagcaugaugcagcuggaccccuccgccaagaccuggaucgacaucgagggccggccggaggaccccgucgagaucgcgcucuaccagcccaugagcgggugcuacauccacuucuuccgcgagcccaccgaccugaagcaguucaagcaggacgccaaguacucccacggcaucgacguggccgaccuguucccggcccagcccggccucaccagcgccgucaucgaggcgcugccccggaacauggugcugacgugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucuga

SEQ ID NO: 1079 - RNA, 1710 nt, Artificial Sequence
  derived and/or modified CDS sequence (opt1) from Lassa virus__AIT17643__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcgcugacggaccuggggcucaucuacaccgccaaguaccccaacuccagcgaccuggaccgccugucccagagccacccgauccucaacaugguggacaccaagaaguccagccugaacaucagcggcuacaacuucucccugggggccgccgugaaggccggcgcgugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgccagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgcgaagaccuggaucgacaucgagggccgcccggaggaccccgucgagaucgcccucuaccagcccauguccgggugcuacauccacuucuuccgggagcccaccgaccugaagcaguucaagcaggacgccaaguacagccacggcaucgacguggccgaccuguucccggcccagcccggccucacguccgcggucaucgaggcccugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcgcugauggacugcaucauguacgacgccgccgucuccggcggccucaacaucccggugcugcgcgccgugcugccccgggacauggucuuccgcaccagcucccccaagguggugcucuga

SEQ ID NO: 1080 - RNA, 1710 nt, Artificial Sequence
  derived and/or modified CDS sequence (opt1) from Lassa virus__AIT17651__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcgcccagcagcucgagcagcgccgggcgcugcugaacaugaucgggauggugggcggcgcccaggggacgcagccgggccgcgacggggugguccgggugugggacgugaagaaccccgaccuccugaacaaccaguucggcaccaugcccucccugacccucgccugccugaccaagcaggggcaggucgaccugaacgacguggugcucgcccugacggaccugggccucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagaccaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgcgucccgcaccagcaucguggggcgggccugggagaacacgaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccgucgagaucgcgcucuaccagcccaugagcgggugcuacauccacuucuuccgggagcccaccgaccugaagcaguucaagcaggacgccaaguacucccacggcaucgacgugacggaccuguucagcgcccagccgggccucaccagcgccgugaucgaggcccugccccgcaacaugguccugaccugccagggguccgacgacaucaagcggcuccuggacagccagggccgccgcgacaucaagcugaucgacaucgcgcucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgccgcgguguccggcggccucaacauccccguccugcgcgccgugcugccgcgggacaugguguuccgcaccagcucccccaaggucgugcucuga

SEQ ID NO: 1081 - RNA, 1710 nt, Artificial Sequence
  derived and/or modified CDS sequence (opt1) from Lassa virus__AIT17655__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacccugaccagcgacgaccugcucacccuggccgccgaccuggagaagcucaagagcaaggugauccgcaccgagaagccccuguccagcgggguguacaugggcaaccuguccacgcagcagcucgagcagcggcgcgcccugcugaacaugaucgggauggucggcggcgcgcaggggacccagccgggccgggacgggguggugcgcgucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguuccccaacuccagcgaccuggaccggcugucccagagccacccgauccucaacaugguggacaccaagaaguccagccugaacaucagcggcuacaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcgcaaccccuacgagaacauccuguacaagaucugccucuccggggacggcuggccguacaucgcgagccggaccuccaucgucgggcgcgccugggagaacaccaccguggaccuggagagcgacggcaagccccagaaggugggcaccacgggguccaacaagagccugcaguccgccggcuuccccaccgggcucaccuacagccagcugaugacccugaaggacuccaugaugcagcuggaccccagcgccaagacguggaucgacaucgagggccggccggaggaccccgucgagaucgcccucuaccagcccauguccgggugcuacauccacuucuuccgcgagcccaccgaccugaagcaguucaagcaggacgcgaaguacagccacggcaucgacguggccgaccuguucccggcccagcccggccucaccuccgccgucaucgaggcccugccccggaacauggugcugaccugccaggggagcgacgacaucaagcgccuccuggacagccagggccggcgcgacaucaagcugaucgacaucgcgcucuccaaggccgacagccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucuccggcggccucaacaucccggugcugcgggccgugcugccccgcgacauggucuuccggaccagcucccccaagguggugcucuga

SEQ ID NO: 1082 - RNA, 1710 nt, Artificial Sequence
  derived and/or modified CDS sequence (opt1) from Lassa virus__AIT17659__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcuguccaugaucgggauggugggcggcgcgcaggggacccagccgggccgcgacggggugguccgggugugggacgugaagaaccccgaccuccugaacaaccaguucggcaccaugcccagccugacccucgccugccugacgaagcaggggcaggucgaccugaacgacgccgugcucgcccugaccgaccugggccucaucuacaccgcgaaguaccccaacuccagcgaccuggaccgccugagccagucccacccgauccucaacaugguggacaccaagaaguccagccugaacaucagcggcuacaacuucucccugggggccgccgucaaggccggcgccugcaugcucgacgggggcaacaugcuggagacgaucaaggugacgccccagaccauggacggcauccucaagagcauccugaaggugaagcggucccuggggauguucgucagcgacacccccggcgagcgcaaccccuacgagaacauccuguacaagaucugccucuccggggacggcuggccguacaucgcgagccggaccuccaucguggggcgcgccugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccggccggaggaccccguggagaucgcgcucuaccagcccauguccgggugcuacauccacuucuuccgcgagcccacggaccugaagcaguucaagcaggacgccaaguacagccacggcaucgacgucgccgaccuguucccggcccagcccggccucaccagcgccgugaucgaggcgcugccccggaacauggugcugaccugccagggguccgacgacaucaagcgccuccuggacagccagggccgccgggacaucaagcugaucgacaucgcccucaacaaggccgacucccgccgguucgagaacgccgucugggaccagugcaaggaccugugccacaugcacaccggggugguggucgagaagaagaagcgcggcgggaaggaggagaucacgccccacugcgcccugauggacugcaucauguacgacgcggccgugagcggcggccucaacaucccggugcugcgggccguccugccccgcgacaugguguuccggaccuccagccccaaggugguccucuga

SEQ ID NO: 1083 - RNA, 1710 nt, Artificial Sequence
  derived and/or modified CDS sequence (opt1) from Lassa virus__AIT17663__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcaccgccgggagcaacaagucccugcagagcgccggcuuccccacggggcucaccuacucccagcugaugacccugaaggacagcaugaugcagcuggaccccuccgccaagaccuggaucgacaucgagggccggccggaggaccccgucgagaucgcgcucuaccagcccaugagcgggugcuacauccacuucuuccgcgagcccacggaccugaagcaguucaagcaggacgccaaguacucccacggcaucgacguggccgaccuguucccggcccagcccggccucaccagcgccgucaucgaggcgcugccccggaacauggugcugaccugccaggggagcgacgacaucaagaagcuccuggacucccagggccgccgcgacaucaagcugaucgacaucgcccucagcaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucuga

SEQ ID NO: 1084 - RNA, 1710 nt, Artificial Sequence
  derived and/or modified CDS sequence (opt1) from Lassa virus__AIT17667__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccaucgacggcauccugaaguccauccucaaggugaagaagucccuggggauguucgugagcgacacccccggcgagcggaaccccuacgagaacauccuguacaagaucugccucagcggggacggcuggccguacaucgcgucccgcaccagcaucgucgggcgggccugggagaacaccaccguggaccuggaguccgacggcaagccccagaaggugggcaccacggggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacgugaccgaccuguucccggcccagcccggccucaccagcgccgucaucgaggcccugccccgcaacauggugcugacgugccaggggagcgaggacaucaagcggcuccuggacucccagggccgccgcgacaucaagcugaucgacaucgcccucagcaaggcggacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgccgccgucagcggcggccucaacaucccggugcugcgcgcggugcugccccgggacauggucuuccgcaccuccagccccaagguggugcucuga

SEQ ID NO: 1085 - RNA, 1710 nt, Artificial Sequence
  derived and/or modified CDS sequence (opt1) from Lassa virus__AIT17671__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacccugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacguggugcucgcccugaccgaccugggccucaucuacaccgccaaguaccccaacagcuccgaccuggaccgccugagccagagccacccgauccucaacauggucgacaccaagaaguccagccugaacaucuccggcuacaacuucagccugggggcggccgugaaggccggcgccugcaugcucgacgggggcaacaugcuggagacgaucaaggugacgccccagaccauggacggcauccugaaguccauccucaaggucaagaagucccuggggauguucgugagcgacacccccggcgagcggaaccccuacgagaacauccuguacaagaucugccucagcggggacggcuggccguacaucgccucccgcaccagcaucguggggcgggcgugggagaacaccaccgucgaccuggaguccgacggcaagccccagaaggugggcaccgccgggagcaacaagucccugcagagcgccggcuuccccacggggcucaccuacucccagcugaugacccugaaggacagcaugaugcagcuggaccccuccgccaagaccuggaucgacaucgagggccgcccggaggaccccgucgagaucgcccucuaccagcccaugagcgggugcuacauccacuucuuccgggagcccacggaccugaagcaguucaagcaggacgcgaaguacucccacggcaucgacgugaccgaccuguucccggcccagcccggccucaccagcgccgugaucgaggcccugccccgcaacaugguccugaccugccaggggagcgacgacaucaagcggcuccuggacucccagggccgccgcgacaucaagcugaucgacaucgcccucagcaaggcggacucccggcgcuucgagaacgccgugugggaccagugcaaggaccugugccacaugcacacggggguggucguggagaagaagaagcggggcgggaaggaggagaucacgccccacugcgcccugauggacugcaucauguacgacgccgccgugagcggcggccucaacaucccgguccugcgcgcggugcugccccgggacaugguguuccgcaccuccagccccaaggucgugcucuga

SEQ ID NO: 1086 - RNA, 1710 nt, Artificial Sequence
  derived and/or modified CDS sequence (opt1) from Lassa virus__AIT17675__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccguccugcgggugggcacgcugaccagcgacgaccugcucacccuggccgccgaccuggagaagcucaaguccaaggugauccgcaccgagcggccccugagcuccggggucuacaugggcaaccugagcacgcagcagcucgagcagcgccgggcccugcugaacaugaucgggauggugggcggcgcgcaggggacccagccgggccgcgacggggugguccgggugugggacgugaagaaccccgaccuccugaacaaccaguucggcaccaugcccucccugacccucgccugccugacgaagcaggggcaggucgaccugaacgacgccgugcucgcccugaccgaccugggccucaucuacaccgcgaaguaccccaacagcuccgaccuggaccgccugagccagagccacccgauccucaacaugguggacaccaagaaguccagccugaacaucuccggcuacaacuucagccugggggccgccgucaaggccggcgccugcaugcucgacgggggcaacaugcuggagacgaucaaggugacgccccagaccauggacggcauccugaaguccauccucaaggugaagaagucccuggggauguucgucagcgacacccccggcgagcggaaccccuacgagaacauccuguacaagaucugccucagcggggacggcuggccguacaucgcgucccgcaccagcaucguggggcgggccugggagaacaccaucguggaccuggaguccgacggcaagccccagaaggucggcaccgccgggagcaacaagucccugcagagcgccggcuuccccaccgggcucacguacucccagcugaugacccugaaggacagcaugaugcagcuggaccccuccgccaagaccuggaucgacaucgagggccgcccggaggaccccguggagaucgcgcucuaccagcccaugagcgggugcuacauccacuucuuccgggagcccaccgaccugaagcaguucaagcaggacgccaaguacucccacggcaucgacgucgccgaccuguucccggcccagcccggccucacgagcgccgugaucgaggcgcugccccgcaacauggugcugaccugccaggggagcgacgacaucaagcggcuccuggacucccagggccgccgcgacaucaagcugaucgacaucgcccucagcaaggccgacucccggcgcuucgagaacgccgucugggaccagugcaaggaccugugccacaugcacaccggggugguggucgagaagaagaagcggggcgggaaggaggagaucacgccccacugcgcccugauggacugcaucauguacgacgcggccgugagcggcggccucaacaucccggugcugcgcgccguccugccccgggacaugguguuccgcaccuccagccccaaggugguccucuga

SEQ ID NO: 1087 - RNA, 1710 nt, Artificial Sequence
  derived and/or modified CDS sequence (opt1) from Lassa virus__AIT17679__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaguccacccagccggggcgcgacggcguggugcgggucugggacgugaagaaccccgaccuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaacaugguggacaccaagaaguccagccugaacaucagcggcuacaacuucucccugggcgccgccgugaaggccggggccugcaugcucgacggcgggaacaugcuggagacgaucaaggucacgccccagaccauggacggcauccucaagagcauccugaaggugaagcggucccugggcauguucgugagcgacacccccggggagcgcaaccccuacgagaacauccuguacaagaucugccucuccggcgacggguggccguacaucgcgagccggaccuccaucgucggccgcgccugggagaacaccaccguggaccuggagagcgacgggaagccccagaaggugggcaccgccggcuccaacaagagccugcaguccgccggguuccccacgggccucaccuacagccagcugaugacccugaaggacuccaugaugcagcuggaccccagcgccaagaccuggaucgacaucgaggggcggccggaggaccccgucgagaucgcgcucuaccagcccauguccggcugcuacauccacuucuuccgcgagcccacggaccugaagcaguucaagcaggacgccaaguacagccacgggaucgacguggccgaccuguucccggcccagcccggccucaccagcgccgucaucgaggcgcugccccggaacauggugcugaccugccagggcuccgacgacaucaagcgccuccuggacagccaggggcgccgggacaucaagcugaucgacaucgcccucuccaaggccgacagccgccgguucgagaacgccgugugggaccagugcaaggaccugugccacaugcacaccggcgucgugguggagaagaagaagcgcgggggcaaggaggagaucacgccccacugcgcccugauggacugcaucauguacgacgcggccgucuccgggggccucaacaucccggugcugcgggccgugcugccccgcgacauggucuuccggaccagcucccccaagguggugcucuga

SEQ ID NO: 1088 - RNA, 1710 nt, Artificial Sequence
  derived and/or modified CDS sequence (opt1) from Lassa virus__AIT17683__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaccaagaaguccagccugaacaucagcggcuucaacuucucccugggggccgccgugaaggccggcgccugcaugcucgacgggggcaacaugcuggagacgaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacaccaccguggaccuggagagcgacggcaagccccagaaggugggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccacggaccugaagcaguucaagcaggacgccaaguacagccacggcaucgacguggccgaccuguucccggcccagcccggccucaccuccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucuga

SEQ ID NO: 1089 - RNA, 1710 nt, Artificial Sequence
  derived and/or modified CDS sequence (opt1) from Lassa virus__AIT17687__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcgcccagcagcucgagcagcgccgggcgcugcugaacaugaucgggauggucggcggcgcccaggggacgcagccgggccgcgacgggguggugcgggucugggacgugaagaaccccgaccuccugaacaaccaguucggcaccaugcccucccugacccucgccugccugaccaagcagggccagguggaccugaacgacgccguccucgcgcugacggaccuggggcucaucuacaccgccaaguaccccaacagcuccgaccuggaccgccugagccagagccacccgauccucaacaugguggacaccaagaaguccagccugaacaucuccggcuacaacuucagccugggggccgccgugaaggccggcgcgugcaugcucgacgggggcaacaugcuggagaccaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgccucccggaccagcaucgucgggcgcgccugggagaacacgaccguggaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccgucgagaucgcccucuaccagcccaugagcgggugcuacauccacuucuuccgcgagcccaccgaccugaagcaguucaagcaggacgccaaguacucccacggcaucgacguggccgaccuguucccggcccagcccggccucacgagcgcggucaucgaggcccugccccggaacauggugcugaccugccaggggagcgacgacaucaagcgccuccuggacucccagggccgccgggacaucaagcugaucgacaucgcccucagcaaggccgacucccgccgguucgagaacgccgugugggaccagugcaaggaccugugccacaugcacaccggggucgugguggagaagaagaagcgcggcgggaaggaggagaucacgccccacugcgcgcugauggacugcaucauguacgacgccgccgucagcggcggccucaacaucccggugcugcgggccgugcugccccgcgacauggucuuccggaccuccagccccaagguggugcucuga

SEQ ID NO: 1090 - RNA, 1710 nt, Artificial Sequence
  derived and/or modified CDS sequence (opt1) from Lassa virus__AIT17695__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgucgugcuggcccugaccgaccucgggcugaucuacaccgccaaguaccccaacuccagcgaccuggaccgccucucccagagccacccgauccugaacaugguggacaccaagaaguccagccugaacaucagcggcuucaacuucucccucggggcggccgucaaggccggcgccugcaugcuggacgggggcaacaugcuggagacgaucaaggugacgccccacaccauggacggcauccucaagagcauccugaaggugaagaagucccuggggauguucgucagcgacacccccggcgagcggaaccccuacgagaacauccucuacaagaucugccuguccggggacggcuggccguacaucgccagccgcaccuccaucguggggcgggcgugggagaacaccaccguggaccuggagagcgacggcaagccccacaaggucggcaccgccggguccaacaagagccuccaguccgccggcuuccccacggggcugaccuacagccagcugaugacccugaaggacuccaugaugcagcucgaccccagcgccaagaccuggaucgacaucgagggccgcccggaggaccccguggagaucgcccuguaccagcccauguccgggugcuacauccacuucuuccgggagcccacggaccugaagcaguucaagcaggacgcgaaguacagccacggcaucgacgucgccgaccucuucccggcccagcccggccugaccuccgccgugaucgaggcccugccccgcaacauggugcugaccugccaggggagcgacgacaucaagcggcuccuggacagccagggccgccgcgacaucaagcucaucgacaucgcgcuguccaaggccgacagccggcgcuucgagaacgccgucugggaccagugcaaggaccugugccacaugcacaccggggugguggucgagaagaagaagcggggcgggaaggaggagaucacgccccacugcgcccucauggacugcaucauguacgacgccgcgguguccggcggccugaacaucccggugcugcgcgccguccucccccgggacaugguguuccgcaccagcucccccaaggugguccuguga

SEQ ID NO: 1091 - RNA, 1710 nt, Artificial Sequence
  derived and/or modified CDS sequence (opt1) from Lassa virus__AIT17705__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccaaccgcagccuccaguccgccggcuuccccacggggcugaccuacagccagcugaugacccugaaggacuccaugaugcagcucgaccccagcgccaagaccuggaucgacaucgagggccggccggaggaccccgucgagaucgcgcuguaccagcccauguccgggugcuacauccacuucuuccgcgagcccacggaccugaagcaguucaagcaggacgccaaguacagccacggcaucgacguggccgaccucuucccggcccagcccggccugaccuccgccgucaucgaggcgcugccccggaacauggugcugaccugccaggggagcgacgacaucaagcgccuccuggacagccagggccgccgggacaucaagcucaucgacaucgcccuguccaaggccgacagccgccgguucgagaacgccgugugggaccagugcaaggaccugugccacaugcacaccggggucgugguggagaagaagaagcgcggcgggaaggaggagaucacgccccacugcgcccucauggacugcaucauguacgacgcggccgucuccggcggccugaacaucccggugcugcgggccgugcucccccgcgacauggucuuccggaccagcucccccaagguggugcuguga

SEQ ID NO: 1092 - RNA, 1710 nt, Artificial Sequence
  derived and/or modified CDS sequence (opt1) from Lassa virus__AIT17711__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaaccucaucgggauggucggcggcgcgcaggggacccagccgggccgcgacgggguggugcgggucugggacgugaagaaccccgaccugcugaacaaccaguucggcaccaugcccagccucacccuggccugccugacgaagcagggccagguggaccucaacgacgccguccuggcccugaccgaccucgggcugaucuacaccgcgaaguaccccaacuccagcgaccuggaccgccucucccagagccacccgauccugaacaugguggacaccaagaaguccagccugaacaucagcggcuucaacuucucccucggggccgccgugaaggccggcgccugcaugcuggacgggggcaacaugcuggagacgaucaaggucacgccccagaccauggacggcauccucaagagcauccugaaggugaagaagucccuggggauguucgugagcgacacccccggcgagcggaaccccuacgagaacauccucuacaagaucugccuguccggggacggcuggccguacaucgcgagccgcaccuccaucgucgggcgggccugggagaacaccaccguggaccuggagagcgacggcaagccccacaaggugggcaccgccggguccagcaagucccuccagagcgccggcuuccccacggggcugaccuacucccagcugaugacccugaaggacagcaugaugcagcucgaccccuccgccaagaccuggaucgacaucgagggccgcccggaggaccccgucgagaucgcgcuguaccagcccaugagcgggugcuacauccacuucuuccgggagcccacggaccugaagcaguucaagcaggacgccaaguacucccacggcaucgacguggccgaccucuucccggcccagcccggccugaccagcgccgucaucgaggcgcugccccgcaacauggugcugaccugccaggggagcgacgacaucaagcggcuccuggacucccagggccgccgcgacaucaagcucaucgacaucgcccugagcaaggccgacucccggcgcuucgagaacgccgugugggaccagugcaaggaccugugccacaugcacaccggggucgugguggagaagaagaagcggggcgggaaggaggagaucacgccccacugcgcccucauggacugcaucauguacgacgcggccgucagcggcggccugaacaucccggugcugcgcgccgugcucccccgggacauggucuuccgcaccuccagccccaagguggugcuguga

SEQ ID NO: 1093 - RNA, 1710 nt, Artificial Sequence
  derived and/or modified CDS sequence (opt1) from Lassa virus__AIT17713__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgccguccucgcccugaccgaccuggggcucaucuacaccgcgaaguaccccaacuccagcgaccuggaccgccugucccagagccacccgauccucaacaugguggacaucaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacguccgccgucaucgaggcgcugccccgcaacauggugcugaccugccaggggagcgacgacaucaagcggcuccuggacagccagggccgccgcgacaucaagcugaucgacaucgcccucaacaaggccgacucccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucagcggcggccucaacaucccggugcugcgcgccgugcugccccgggacauggucuuccgcaccuccagccccaagguggugcucuga

SEQ ID NO: 1094 - RNA, 1710 nt, Artificial Sequence
  derived and/or modified CDS sequence (opt1) from Lassa virus__AIT17719__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucuccggcgcgcagggcacccagccggggcgcgacggcguggugcgggucugggacgugaagaaccccgagcuccugaacaaccaguucgggaccaugcccagccugacccucgccugccugacgaagcagggccagguggaccugaacgacgccguccucgcccugaccgaccuggggcucaucuacaccgcgaaguaccccaacuccagcgaccuggaccgccugagccagucccacccgauccucaacaugguggacaccaagaaguccagccugaacaucagcggcuacaacuucucccugggcgccgccgugaaggccggggccugcaugcucgacggcgggaacaugcuggagacgaucaaggucacgccccagaccauggacggcauccucaagagcauccugaaggugaagaagucccugggcauguucgugagcgacacccccggggagcggaaccccuacgagaacauccuguacaagaucugccucuccggcgacggguggccguacaucgcgagccgcaccuccaucgucggccgggccugggagaacaccaccguggaccuggagagcgacgggaagccccagaaggugggcaccgccggcuccaacaagagccugcaguccgccggguuccccacgggccucaccuacagccagcugaugacccugaaggacuccaugaugcagcuggaccccagcgccaagaccuggaucgacaucgaggggcgcccggaggaccccgucgagaucgcgcucuaccagcccauguccggcugcuacauccacuucuuccgggagcccacggaccugaagcaguucaagcaggacgccaaguacagccacgggaucgacguggccgaccuguucccggcccagcccggccucaccagcgccgucaucgaggcgcugccccgcaacauggugcugaccugccagggcuccgacgacaucaagcggcuccuggacagccaggggcgccgcgacaucaagcugaucgacaucucccucagcaaggccgacucccggcgcuucgagaacgccgugugggaccagugcaaggaccugugccacaugcacaccggcgucgugguggagaagaagaagcgcgggggcaaggaggagaucacgccccacugcgcccugauggacugcaucauguacgacgccgcggucagcgggggccucaacaucccggugcugcgggccgugcugccccgggacauggucuuccgcaccuccagccccaagguggugcucuga

SEQ ID NO: 1095 - RNA, 1710 nt, Artificial Sequence
  derived and/or modified CDS sequence (opt1) from Lassa virus__AIT17725__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccgcccagcagcucgagcagcgccgggcgcugcugaacaugaucgggauggucggcggcgcccaggggacgcagcucggccgcgacgggguggugcgggucugggacgugaagaacccggaccugcugaacaaccaguucggcaccaugcccagccucacccuggccugccugaccaagcagggccagguggaccucaacgacgccguccuggcgcugacggaccucgggcugaucuacaccgccaaguaccccaacuccagcgaccuggaccgccucucccagagccaccccauccugaacaugguggacaccaagaaguccagccugaacaucagcggcuacaacuucucccucggggccgccgugaaggccggcgcgugcaugcuggacgggggcaacaugcuggagaccaucaaggucacgccgcagaccauggacggcauccucaagagcauccugaaggugaagaagucccuggggauguucgugagcgacacccccggcgagcggaaccccuacgagaacauccucuacaagaucugccuguccggggacggcuggcccuacaucgccagccgcaccuccaucgucgggcgggccugggagaacacgaccguggaccuggagagcgacggcaagccgcagaaggugggcaccgccggguccaacaagagccuccaguccgccggcuuccccaccgggcugacguacagccagcugaugacccugaaggacuccaugaugcagcucgaccccagcgcgaagaccuggaucgacaucgagggccgccccgaggacccggucgagaucgcccuguaccagcccauguccgggugcuacauccacuucuuccgggagcccaccgaccugaagcaguucaagcaggacgccaaguacagccacggcaucgacguggccgaccucuuccccgcccagccgggccugacguccgcggucaucgaggcccugccccgcaacauggugcugaccugccaggggagcgaggacaucaagcggcuccuggacagccagggccgccgcgacaucaagcucaucgacaucgcccuguccaaggccgacagccggcgcuucgagaacgccgugugggaccagugcaaggaccugugccacaugcacaccggggucgugguggagaagaagaagcggggcgggaaggaggagaucacgccccacugcgcgcucauggacugcaucauguacgacgccgccgucuccggcggccugaacauccccgugcugcgcgccgugcucccgcgggacauggucuuccgcaccagcucccccaagguggugcuguga

SEQ ID NO: 1096 - RNA, 1710 nt, Artificial Sequence
  derived and/or modified CDS sequence (opt1) from Lassa virus__AIT17729__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagcgccgggacgacuccgaccugaagcgccugcgggaccucaaccaggccgugaacaaccugguggagcucaagagcacccagcagaaguccauccugcgcgucggcacccugaccagcgacgaccugcucacccuggccgccgaccuggagaagcucaaguccaaggugauccggaccgagcgcccccugagcuccgggguguacaugggcaaccugagcacgcagcagcucgagcagcggcgcgcccugcugaacaugaucgggauggucggcggcacccaggggacccagccgggccgggacgggguggugcgcgucugggacgugaagaaccccgaccuccugaacaaccaguucggcaccaugcccucccugacgcucgcgugccugaccaagcagggccagguggaccugaacgacgccguccucgcccugaccgaccuggggcucaucuacaccgccaaguaccccaacagcuccgaccuggaccggcugagccagagccacccgauccucaacaugguggacacgaagaaguccagccugaacaucuccggcuacaacuucagccugggggcggccgugaaggccggcgccugcaugcucgacgggggcaacaugcuggagaccaucaaggucacgccccagaccauggacggcauccugaaguccauccucaaggugaagcgcagccuggggauguucguguccgacacccccggcgagcggaaccccuacgagaacauccuguacaagaucugccucagcggggacggcuggccguacaucgccucccgcaccagcaucgucgggcgggcgugggagaacaccaccguggaccuggaguccgacggcaagccccagaaggugggcacggccgggagcaacaagucccugcagagcgccggcuuccccaccgggcucaccuacucccagcugaugacccugaaggacagcaugaugcagcuggaccccuccgccaagacguggaucgacaucgagggccgcccggaggaccccgucgagaucgcccucuaccagcccaugagcgggugcuacauccacuucuuccgggagcccaccgaccugaagcaguucaagcaggacgcgaaguacucccacggcaucgacguggccgaccuguucccggcccagcccggccucaccagcgccgucaucgaggcccugccccgcaacauggugcugaccugccaggggagcgacgacaucaagcgccuccuggacucccagggccggcgcgacaucaagcugaucgacaucgcgcucagcaaggccgacucccggaaguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucagcggcggccucaacaucccggugcugcgggccgugcugccccgcgacauggucuuccggaccuccagccccaagguggugcucuga

SEQ ID NO: 1097 - RNA, 1710 nt, Artificial Sequence
  derived and/or modified CDS sequence (opt1) from Lassa virus__AIT17733__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucauccuggccgccgaccuggagaagcucaagagcaaggugauccgcaccgagcggccccuguccagcgggguguacaugggcaaccuguccacccagcagcucgagcagcgccgggcccugcugaacaugaucgggauggucggcggcgcgcaggggacgcagccgggccgcgacgggguggugcgggucugggacgugaagaaccccgaccuccugaacaaccaguucggcaccaugcccagccugacccucgccugccugaccaagcagggccagguggaccugaacgacgccguccucgcccugacggaccuggggcucaucuacaccgcgaaguaccccaacuccagcgaccuggaccgccugucccagagccacccgauccucaacaugguggacaccaagaaguccagccugaacaucagcggcuacaacuucucccugggggccgccgugaaggccggcgccugcaugcucgacgggggcaacaugcuggagaccaucaaggucacgccccagaccauggacggcauccucaagagcauccugaaggugaagaagucccuggggauguucgugagcgacacccccggcgagcggaaccccuacgagaacauccuguacaagaucugccucuccggggacggcuggccguacaucgcgagccgcaccuccaucgucgggcgggccugggagaacacgaccguggaccuggagagcgacggcaagccccagaaggugggcaccgccggguccaacaagagccugcaguccgccggcuuccccaccgggcucacguacagccagcugaugacccugaaggacuccaugaugcagcuggaccccagcgccaagaccuggaucgacaucgagggccgcccggaggaccccgucgagaucgcgcucuaccagcccauguccgggugcuacauccacuucuuccgggagcccaccgaccugaagcaguucaagcaggacgccaaguacagccacggcaucgacguggccgaccuguucccggcccagcccggccucacguccgccgucaucgaggcgcugccccgcaacauggugcugaccugccaggggagcgacgacaucaagcggcuccuggacagccagggccgccgcgacaucaagcugaucgacaucgcccucuccaaggccgacagccggcgcuucgagaacgccgugugggaccagugcaaggaccugugccacaugcacaccggggucgugguggagaagaagaagcggggcgggaaggaggagaucacgccccacugcgcccugauggacugcaucauguacgacgcggccgucuccggcggccucaacaucccggugcugcgcgccgugcugccccgggacauggucuuccgcaccagcucccccaagguggugcucuga

SEQ ID NO: 1098 - RNA, 1710 nt, Artificial Sequence
  derived and/or modified CDS sequence (opt1) from Lassa virus__AIT17745__NP
augagcgccuccaaggagaucaagagcuuccuguggacccagucccuccgccgggagcugagcggcuacugcuccagcaucaagcuccagguggucaaggacgcccaggcgcugcugcacgggcuggacuucuccgaggugagcaacgugcagcgccucaugcggaagcagaagcgcgacgacuccgaccugaagcggcugcgcgaccucaaccaggccgucaacaaccugguggagcucaagagcacccagcagaaguccauccugcgggugggcacgcugaccagcgacgaccugcucacccuggccgccgaccuggagaagcucaaguccaaggucauccgcaccgagcggccccugagcuccgggguguacaugggcaaccugagcacgcagcagcucgagcagcgccgggcccugcugaacaugaucgggauggugggcggcgcgcaggggacccagccgggccgcgacggggucgugcgggugugggacgucaagaaccccgaccuccugaacaaccaguucggcaccaugcccucccugacccucgccugccugacgaagcagggccagguggaccugaacgacgccgugcucgcccugaccgaccuggggcucaucuacaccgcgaaguaccccaacagcuccgaccuggaccgccugagccagagccacccgauccucaacauggucgacaccaagaaguccagccugaacaucuccggcuacaacuucagccugggggccgccgugaaggccggcgccugcaugcucgacgggggcaacaugcuggagacgaucaaggugacgccccagaccauggacggcauccugaaguccauccucaaggucaagcggagccuggggauguucguguccgacgcgcccggcgagcgcaaccccuacgagaacauccuguacaagaucugccucagcggggacggcuggccguacaucgccucccggaccagcaucguggggcgcgccugggagaacaccaccgucgaccuggaguccgacggcaagccccagaaggugggcaccgccgggagcaacaagucccugcagagcgccggcuuccccaccgggcucacguacucccagcugaugacccugaaggacagcaugaugcagcuggaccccuccgcgaagaccuggaucgacaucgagggccggccggaggaccccguggagaucgcccucuaccagcccaugagcgggugcuacauccacuucuuccgcgagcccaccgaccugaagcaguucaagcaggacgccaaguacucccacggcaucgacgucgccgaccuguucccggcccagcccggccucacgagcgcggugaucgaggcccugccccggaacaugguccugaccugccaggggagcgacgacaucaagcgccuccuggacucccagggccgccgggacaucaagcugaucgacaucgcccucagcaagguggacucccgccgguucgagaacgccgugugggaccagugcaaggaccugugccacaugcacaccggggucgugguggagaagaagaagcgcggcgggaaggaggagaucacgccccacugcgcccugauggacugcaucauguacgacgcggccgucagcggcggccucaacaucccggugcugcgggccgugcugccccgcgacauggucuuccggaccuccagccccaagguggugcucuga

SEQ ID NO: 1099 - RNA, 1710 nt, Artificial Sequence
  derived and/or modified CDS sequence (opt1) from Lassa virus__AIT17753__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagccccagaaggugggcaccacggggagcaacaagucccugcagagcgccggcuuccccaccgggcucaccuacucccagcugaugacccugaaggacagcaugaugcagcuggaccccuccgccaagacguggaucgacaucgagggccggccggaggaccccgucgagaucgcccucuaccagcccaugagcgggugcuacauccacuucuuccgcgagcccaccgaccugaagcaguucaagcaggacgcgaaguacucccacggcaucgacguggccgaccuguucccggcccagcccggccucaccagcgccgucaucgaggcccugccccggaacauggugcugaccugccaggggagcgacgacaucaagcgccuccuggacucccagggccgccgggacaucaagcugaucgacaucgcgcucagcaaggccgacucccgccgguucgagaacgccgugugggaccagugcaaggaccugugccacaugcacacgggggucgugguggagaagaagaagcgcggcgggaaggaggagaucacgccccacugcgcccugauggacugcaucauguacgacgccgcggucagcggcggccucaacaucccggugcugcgggccgugcugccccgcgacauggucuuccggaccuccagccccaagguggugcucuga

SEQ ID NO: 1100 - RNA, 1710 nt, Artificial Sequence
  derived and/or modified CDS sequence (opt1) from Lassa virus__AIT17763__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacgcugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccguggacggcauccugaaguccauccucaaggugaagcggagccuggggauguucgucuccgacacccccggcgagcgcaaccccuacgagaacauccuguacaagaucugccucagcggggacggcuggccguacaucgcgucccggaccagcaucguggggcgcgccugggagaacaccaccguggaccuggaguccgacgagaagccccagaaggucggcgccgccggcagcaacaagucccugcagagcgccggguuccccaccggccucacguacucccagcugaugacccugaaggacagcaugaugcagcuggaccccuccgcgaagaccuggaucgacaucgaggggcggccggaggaccccguggagaucgcccucuaccagcccaugagcggcugcuacauccacuucuuccgcgagcccaccgaccugaagcaguucaagcaggacgccaaguacucccacgggaucgacgucacggaccuguucccggcccagcccggccucaccagcgccgugaucgaggcgcugccccggaacauggugcugaccugccagggcagcgacgacaucaagcgccuccuggacucccaggggcgccgggacaucaagcugaucgacaucgcccucagcaaggccgacucccgccgguucgagaacgccgucugggaccagugcaaggaccugugccacaugcacaccggcgugguggucgagaagaagaagcgcgggggcaaggaggagaucacgccccacugcgcccugauggacugcaucauguacgacgcggccgugagcgggggccucaacaucccggugcugcgggccguccugccccgcgacaugguguuccggaccuccagccccaaggugguccucuga

SEQ ID NO: 1101 - RNA, 1710 nt, Artificial Sequence
  derived and/or modified CDS sequence (opt1) from Lassa virus__AIT17771__NP
augagcgccuccaaggaggugaaguccuuccuguggacccagagccuccgccgggagcugagcggcuacugcuccagcaucaagcugcaggucgugaaggacgcccaggcgcuccugcacgggcuggacuucuccgaggugagcaacguccagcgccucaugcggaagcagaagcgcgacgacuccgaccugaagcggcugcgcgaccucaaccaggccgugaacaaccugguggagcucaagagcacccagcagaaguccauccugcgggucggcacccugaccagcgacgaccugcucacccuggccgccgaccuggagaagcucaaguccaaggugauccgcaccgagcggccccugagcuccgggguguacaugggcaaccugagcacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccucccugacccucgccugccugacgaagcagggccagguggaccugaacgacgccguccucgcccugaccgaccuggggcucaucuacaccgcgaaguaccccaacagcuccgaccuggaccgccugagccagagccacccgauccucaacaugguggacaccaagaaguccagccugaacaucuccggcuacaacuucagccugggggccgccgugaaggccggcgccugcaugcucgacgggggcaacaugcuggagacgaucaaggucacgccccagaccauggacggcauccugaaguccauccucaaggugaagcggagccuggggauguucguguccgacacccccggcgagcgcaaccccuacgagaacauccuguacaagaucugccucagcggggacggcuggccguacaucgcgucccggaccagcaucgucgggcgcgccugggagaacaccaccguggaccuggaguccgacggcaagacccagaaggugagcacggccggcuccaacaagagccugcaguccgccggguuccccaccggccucaccuacagccagcugaugacccugaaggacuccaugaugcagcuggaccccagcgccaagacguggaucgacaucgaggggcggcccgaggacccggucgagaucgcgcucuaccagcccauguccggcugcuacauccacuucuuccgcgagcccaccgaccugaagcaguucaagcaggacgccaaguacagccacgggaucgacgugaccgaccuguuccccgcccagccgggccucaccagcgccgucaucgaggcccugccccggaacauggugcugacgugccagggcuccgacgacaucaagcgccuccuggacagccaggggcgccgggacaucaagcugaucgacaucgcgcucuccaaggccgacagccgccgguucgagaacgccgugugggaccagugcaaggaccugugccacaugcacaccggcgucgugguggagaagaagaagcgcgggggcaaggaggagaucacgccccacugcgcccugauggacugcaucauguacgacgccgcggucuccgggggccucaacauccccgugcugcgggccgugcugccgcgcgacauggucuuccggaccagcucccccaagguggugcucuga

SEQ ID NO: 1102 - RNA, 1710 nt, Artificial Sequence
  derived and/or modified CDS sequence (opt1) from Lassa virus__AIT17779__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaagacggacagccggcgcuucgagaacgccgugugggaccagugcaaggaccugugccacaugcacaccggcgucgugguggagaagaagaagcgcgggggcaaggaggagaucacgccccacugcgcccugauggacugcaucauguacgacgccgccgucuccggcgggcucaacauccccgugcugcgggcggugcugccgcgggacauggucuuccgcaccagcucccccaagguggugcucuga

SEQ ID NO: 1103 - RNA, 1710 nt, Artificial Sequence
  derived and/or modified CDS sequence (opt1) from Lassa virus__AIT17783__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacagcgaccugaagcggcugcgcgaccucaaccaggccgugaacaaccugguggagcugaaguccacccagcagaaguccauccuccgggucggcacgcugaccagcgacgaccugcucacccuggccgccgaccuggagaagcucaagagcaaggugauccgcaccgagcggccccuguccagcgggguguacaugggcaaccuguccacgcagcagcucgagcagcgccgggcccugcugaacaugaucgggauggucggcggcgcgcaggggacccagccgggccgcgacgggguggugcgggucugggacgugaagaaccccgaccuccugaacaaccaguucggcaccaugcccagccugacccucgccugccugacgaagcagggccagguggaccugaacgacgucgugcucgcccugaccgaccuggggcucaucuacaccgccaaguaccccaacuccagcgaccuggaccgccugucccagagccacccgauccucaacaugguggacaccaagaaguccagccugaacaucagcggcuacaacuucucccugggggcggccgucaaggccggcgccugcaugcucgacgggggcaacaugcuggagacgaucaaggugacgccccagaccauggacggcauccucaagagcauccugaaggugaagaagucccuggggauguucgucagcgacacccccggcgagcggaaccccuacgagaacauccuguacaagaucugccucuccggggacggcuggccguacaucgccagccgcaccuccaucguggggcgggcgugggagaacaccaccguggaccuggagagcgacggcaagccccagaaggucggcaccgccggguccaacaagagccugcaguccgccggcuuccccacggggcucaccuacagccagcugaugacccugaaggacuccaugaugcagcuggaccccagcgccaagaccuggaucgacaucgagggccgcccggaggaccccguggagaucgcccucuaccagcccgucuccgggugcuacauccacuucuuccgggagcccacggaccugaagcaguucaagcaggacgcgaaguacagccacggcaucgacguggccgaccuguucccggcccagcccggccucaccuccgccgugaucgaggcccugccccgcaacaugguccugaccugccaggggagcgacgacaucaagcggcuccuggacagccagggccgccgcgacaucaagcugaucgacaucgcgcucuccaaggccgacagccggcgcuucgagaacgccgugugggaccagugcaaggaccugugccacaugcacaccgggguggucguggagaagaagaagcggggcgggaaggaggagaucacgccccacugcgcccugauggacugcaucauguacgacgccgcgguguccggcggccucaacaucccgguccugcgcgccgugcugccccgggacaugguguuccgcaccagcucccccaaggucgugcucuga

SEQ ID NO: 1104 - RNA, 1710 nt, Artificial Sequence
  derived and/or modified CDS sequence (opt1) from Lassa virus__AIT17787__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagaagcgcgacgacggcgaccugaagcggcugcgcgaccucaaccaggccgugaacaaccugguggagcucaagagcacccagcagaaguccauccugcgggucgggacccugaccagcgacgaccugcucacccuggccgccgaccuggagaagcucaaguccaaggugauccgcaccgagcggccccugagcuccggcguguacauggggaaccugagcacgcagcagcucgagcagcgccgggcccugcugaacaugaucggcauggucggcggggcgcagggcacccagccggggcgcgacggcguggugcgggucugggacgugaagaaccccgaccuccugaacaaccaguucgggaccaugcccucccugacccucgccugccugacgaagcagggccagguggaccugaacgacgccguccucgcccugaccgaccugggccucaucuacaccgcgaaguaccccaacagcuccgaccuggaccgccugagccagucccacccgauccucaacaugguggacaccaagaaguccagccugaacaucagcggguacaacuucagccugggcgccgccgugaaggccggggccugcaugcucgacggcggcaacaugcuggagacgaucaaggucacgccccagaccauggacgggauccugaaguccauccucaaggugaagaagucccugggcauguucgugagcgacacccccggggagcggaaccccuacgagaacauccuguacaagaucugccucagcggcgacggguggccguacaucgcgucccgcaccagcaucgucggccgggccugggagaacaccaccguggaccuggaguccgacggcaagccccagaagguggggaccgccggcagcaacaagucccugcagagcgccggguuccccacgggccucaccuacucccagcugaugacccugaaggacagcaugaugcagcuggaccccuccgccaagaccuggaucgacaucgaggggcgcccggaggaccccgucgagaucgcgcucuaccagcccaugagcggcugcuacauccacuucuuccgggagcccacggaccugaagcaguucaagcaggacgccaaguacucccacggcaucgacgugaccgaccuguucagcgcccagccggggcucaccuccgccgucaucgaggcccugccccgcaacauggugcugaccugccagggcagcgacgacaucaagcggcuccuggacagccaggggcgccgcgacaucaagcugaucgacaucgcgcucuccaagguggacagccggcgcuucgagaacgccgucugggaccagugcaaggaccugugccacaugcacacgggcgugguggucgagaagaagaagcgcgggggcaaggaggagaucacgccccacugcgcccugauggacugcaucauguacgacgccgccguguccggcgggcucaacauccccgugcugcgggcgguccugccgcgggacaugguguuccgcaccagcucccccaaggugguccucuga

SEQ ID NO: 1105 - RNA, 1710 nt, Artificial Sequence
  derived and/or modified CDS sequence (opt1) from Lassa virus__AIT17803__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcucccaggaggcccgggccgggcgcgacggcgugguccgggugugggacgugaagaacgccgagcuccugaacaaccaguucgggaccaugccgagccugacgcucgcgugccugaccaagcagggccaggucgaccugaacgacgccgugcaggcccucaccgaccuggggcugaucuacaccgccaaguaccccaacacguccgaccucgaccgccugacccagagccaccccauccugaacaugaucgacaccaagaaguccagccucaacaucagcggcuacaacuucucccugggcgccgcggugaaggccggggccugcaugcuggacggcgggaacaugcucgagaccaucaaggucagcccccagacgguggacggcauccugaaguccauccugaaggugaagaaggcccucggcauguucaucagcgacaccccgggggagcggaaccccuacgagaacauccuguacaagaucugccuguccggcgacggguggcccuacaucgccagccgcaccuccaucaccggccgggcgugggagaacacggucguggaccucgagagcgacgggaagccccagaaggccggcuccaacaacagcaacaagucccugcagagcgccggcuucaccgccgggcugaccuacucccagcucaugacccugaaggacgccaugcugcagcuggacccgaacgcgaagacguggauggacaucgagggccgccccgaggaccccguggagaucgcccucuaccagcccagcuccgggugcuacauccacuucuuccgggagccgaccgaccugaagcaguucaagcaggacgccaaguacagccacggcaucgacgucaccgaccuguucgccgcccagcccgggcucaccuccgcggugaucgacgcccugccccgcaacauggugaucacgugccagggcagcgacgacauccgcaagcugcucgagagccagggccggaaggacaucaagcugaucgacaucgcccuguccaagaccgacagccgcaaguacgagaacgccgucugggaccaguacaaggaccucugccacaugcacaccgggguggucguggagaagaagaagaagggcgggaaggaggagaucacgccccacugcgcgcugauggacugcaucauguucgacgccgccguguccggcgggcugaacaccagcguccuccgggccgugcugccgcgcgacaugguguuccggaccuccacgccccgcgucgugcuguga

SEQ ID NO: 1106 - RNA, 1710 nt, Artificial Sequence
  derived and/or modified CDS sequence (opt1) from Lassa virus__AIT17811__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacaccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgccuucuaccagcccuccagcggcugcuacauccacuucuuccgggagccgaccgaccucaagcaguucaagcaggacgccaaguacucccacgggaucgacgugaccgaccuguucgccgcccagcccggccugacgagcgcggucaucgacgcccucccccgcaaccuggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacgccuccgugcugcgggccgugcucccccgggacauggucuuccgcaccagcacgccccggguggugcuguga

SEQ ID NO: 1107 - RNA, 1710 nt, Artificial Sequence
  derived and/or modified CDS sequence (opt1) from Lassa virus__AIT17815__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcuggacaugaucgggauguccggcagcaaccagggcgcccgggccgggcgcgacggcgugguccgggugugggacgugaagaacgccgagcuccugaacaaccaguucgggacgaugccgucccugacccucgcgugccugaccaagcagggccaggucgaccugaacgacgccgugcaggcccucaccgaccuggggcugaucuacacggccaaguaccccaacaccagcgaccucgaccgccugacccagucccaccccauccugaacaugaucgacaccaagaaguccagccucaacaucuccggcuacaacuucagccugggcgccgcggugaaggccggggccugcaugcuggacggcgggaacaugcucgagacgaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgcgucccgcaccagcaucaccggccgggccugggagaacacgguggucgaccucgaguccgacgggaagccccagaaggccggcagcaacggcuccaacaagagccugcaguccgccggguucaccgccggccugaccuacagccagcucaugacccugaaggacgcgaugcugcagcuggacccgaacgccaagacguggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcgcagcccggccucaccagcgccgucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgcggugugggaccaguacaaggaccugugccacaugcacaccggcaucgucguggagaagaagaagcgcgggggcaaggaggagaucacgccccacugcgcccucauggacugcaucauguucgacgccgccgucagcgggggccugaacaccuccgugcugcgggccgugcucccgcgggacauggucuuccgcaccagcacgccccggguggugcuguga

SEQ ID NO: 1108 - RNA, 1710 nt, Artificial Sequence
  derived and/or modified CDS sequence (opt1) from Lassa virus__AIT17821__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcuguccaugaucgggaugagcggcggcaaccagggggcccgggccggccgcgacggggugguccgggugugggacgugaagaacgccgagcuccugaacaaccaguucggcaccaugccgucccugacgcucgcgugccugaccaagcaggggcaggucgaccugaacgacgccgugcaggcccucaccgaccugggccugaucuacaccgccaaguaccccaacacgagcgaccucgaccgccugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgguggacggcauccucaagagcauccugaaggugaagaaggcccuggggauguucaucuccgacaccccgggcgagcggaaccccuacgagaacauccuguacaagaucugccugagcggggacggcuggcccuacaucgccucccgcaccagcaucaccgggcgggcgugggagaacacggucguggaccucgaguccgacggcaagccccagaagaccggcagcaacaacuccaacaagagccugcaguccgccggguucaccgccggccugaccuacagccagcucaugacgcugaaggacgccaugcugcagcuggacccgaacgccaagaccuggauggacaucgaggggcgccccgaggaccccguggaggucgcgcucuaccagcccuccagcggcugcuacauccacuucuuccgggagccgaccgaccugaagcaguucaagcaggacgccaaguacucccacgggaucgacgugaccgaccuguucgccgcccagcccggccucacgagcgccgugaucgacgcgcugccccgcaacauggucaucacgugccagggcuccgacgacauccgcaagcugcucgagagccaggggcggaaggacaucaagcugaucgacaucgcccugagcaagaccgacucccgcaaguacgagaacgccgugugggaccaguacaaggaccucugccacaugcacaccggcgucgugguggagaagaagaagcgcgggggcaaggaggagaucaccccgcacugcgcccugauggacugcaucauguucgacgcggccgucagcgggggccugaacaccuccgugcuccgggccgugcugccccgggacauggucuuccgcaccagcacgccccggguggugcuguga

SEQ ID NO: 1109 - RNA, 1710 nt, Artificial Sequence
  derived and/or modified CDS sequence (opt1) from Lassa virus__AIT17837__NP
augagcaacuccaaggagaucaagagcuuccuguggacccagucccuccgccgggagcugagcggcuacugcuccaacaucaagcuccagguggucaaggacgcccaggcccugcugcacgggcuggacuucagcgagguguccaacgugcagcgccucaugcggaagcagaagcgcgacgacgcggaccugaagcggcugcgcgaccucaaccaggccgucaacaaccugguggagcucaagagcacccagcagaagaacgugcugcgggucggcacgcuguccagcgacgaccugaucacccucgccgccgaccuggagaagcugaaguccaaggugauccgcaccgagcggccccucagcuccgggguguacaugggcaaccugagcucccagcagcuggaccagcgccgggcccuccugagcaugaucgggauguccggcggcccgcaggggaaccgcaccggcggggacggcgucgugcgggugugggacgucaagaacgcggagcugcucaacaaccaguucgggacgaugcccagccugacccuggccugccucaccaagcagggccagguggaccugaacgacgccgugcaggcccugaccgaccucggccugaucuacacggcgaaguaccccaacuccagcgaccuggacaugcucacccagagccaccccauccuggggauggucgacaccaagaaguccagccugaacaucuccggcuacaacuucagccucggggccgccgugaaggccggcgccugcaugcuggacggcgggaacaugcuggagaccaucaagguguccccgcagacgauggacggcauccucaagagcauccugaaggucaagcgcucccuggggauguucaucagcgacacccccggcgagcggaaccccuacgagaacauccucuacaagaucugccuguccggggagggcuggcccuacaucgcgagccgcaccuccaucaccggccgggccugggagaacacgcugguggaccucgagagcgacaacaagccgcccaagcugaacuccgccgggagcaacaagucccugcaggccgccggccucaacgcggggcugaccuacagccagcugaugacccugaaggacugcaugcuccagcuggaccccuccagcaagaccuggaucgacaucgagggccgccccgaggacccgguggagaucgcccuguuccagcccuccagcgggugcuacauccacuucuuccgggagcccacggaccucaagcaguucaagcaggacgccaaguacagccacggcaucgacgucaccgaccuguucuccacccagcccggccugaccagcgccgugaucgaggcccucccgcgcaacauggugcugacgugccagggguccgacgacaucaagaagcugcucgagagccagggccggcgcgacaucaagcugaucgacaucucccugagcaaggcggacucccgcaaguucgagaacgccgucugggaccaguacaaggaccucugccacaugcacaccgggguggucguggagaagaagaagcggggcgggaaggaggagaucacgccccacugcgcccugcuggacugcaucauguucgacgccgccaccaccggcagccucaacaucaccacccugcgcgcggugcugccccgggacauggucuuccgcaccuccacgcccaagguggugcucuga

SEQ ID NO: 1110 - RNA, 1710 nt, Artificial Sequence
  derived and/or modified CDS sequence (opt1) from Lassa virus__AIT17841__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccggacggggcgcgacggcgugguccgggugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccgccugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacgccccgggggagcggaaccccuacgagaacauccuguacaagaucugccugagcggcgacggguggcccuacaucgccucccgcaccagcaucacgggccgggcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcgccccgaggaccccguggagaucgcccucuaccagcccuccagcggcugcuacauccacuucuuccgggagccgaccgaccugaagcaguucaagcaggacgccaaguacucccacgggaucgacgugaccgaccuguucgccgcccagcccggccucacgagcgcggucaucgacgcccugccccgcaacauggugaucacgugccagggcuccgacgacauccgcaagcuguucgagagccaggggcggaaggacaucaagcucaucgacaucgcccugagcaagaccgacucccgcaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacaccuccgugcugcgggccgugcucccccgggacauggucuuccgcaccagcacgccccggguggugcuguga

SEQ ID NO: 1111 - RNA, 1710 nt, Artificial Sequence
  derived and/or modified CDS sequence (opt1) from Lassa virus__AIT17845__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucacccggaccgagcgcccccugagcgccgggguguacaugggcaaccuguccagccagcagcucgaccagcggcgcgcgcugcugaacaugaucgggauguccggcagcaaccagggcgcccagacggggcgggacggcgugguccgcgugugggacgugaagaacgccgagcuccugaacaaccaguucgggaccaugccgucccugacccucgccugccugaccaagcagggccaggucgaccugaacgacgcggugcaggcccucacggaccuggggcugaucuacaccgccaaguaccccaacaccagcgaccucgaccggcugacccagucccaccccauccugaacaugaucgacacgaagaaguccagccucaacaucuccggcuacaacuucagccugggcgccgccgugaaggcgggggccugcaugcuggacggcgggaacaugcucgagaccaucaaggucagcccccagaccauggacggcauccucaagagcauccugaaggugaagaaggcccugggcauguucaucuccgacgccccgggggagcgcaaccccuacgagaacauccuguacaagaucugccugagcggcgacggguggcccuacaucgccucccggaccagcaucacgggccgcgcgugggagaacaccguggucgaccucgaguccgacgggaagccccagaaggccggcagcaacggcuccaacaagagccugcaguccgccggguucaccgccggccugaccuacagccagcucaugacgcugaaggacgccaugcugcagcuggacccgaacgcgaagaccuggauggacaucgaggggcggcccgaggaccccguggagaucgcccucuaccagcccuccagcggcugcuacauccacuucuuccgcgagccgaccgaccugaagcaguucaagcaggacgccaaguacucccacgggaucgacgugaccgaccuguucgccgcccagcccggccucacgagcgcggucaucgacgcccugccccggaacauggugaucacgugccagggcuccgacgacauccgcaagcuguucgagagccaggggcgcaaggacaucaagcucaucgacaucgcccugagcaagaccgacucccggaaguacgagaacgccgugugggaccaguacaaggaccugugccacaugcacaccggcaucgucguggagaagaagaagcgcgggggcaaggaggagaucaccccgcacugcgcgcucauggacugcaucauguucgacgccgccgucagcgggggccugaacaccuccgugcugcgggccgugcucccccgcgacauggucuuccggaccagcacgccccgcguggugcuguga

SEQ ID NO: 1112 - RNA, 1710 nt, Artificial Sequence
  derived and/or modified CDS sequence (opt1) from Lassa virus__ANH09723__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucacccuggccgccgaccuggagaagcucaaguccaaggugacccggacggagcgcccccugaccgccgggguguacaugggcaaccugagcucccagcagcucgaccagcggcgcgcgcugcugaacaugaucgggaugagcggcggcaaccagggggcccggaccggccgcgacggggucgugcgggugugggacgucaagaacgccgagcuccugaacaaccaguucggcaccaugccgucccugacgcucgccugccugaccaagcagggccagguggaccugaacgacgugguccaggcgcucaccgaccuggggcugaucuacaccgccaaguaccccaacacgagcgaccucgaccgccugacccagucccaccccauccugaacaugaucgacaccaacaagagcucccucaacaucagcggcuacaacuucagccugggggccgccgugaaggccggcgcgugcaugcuggacgggggcaacaugcucgagaccaucaaggugagcccccagacgauggacggcauccucaagagcauccugaaggucaagaagucccuggggauguucaucagcgacaccccgggcgagcggaaccccuacgagaacauccuguacaagaucugccuguccggggacggcuggcccuacaucgccagccgcaccuccaucaccgggcgggccugggagaacacggugguggaccucgagagcggcggcaagccccagaaggccggguccaacaacagcaacaagucccugcagagcgccggcuucgcggccgggcugaccuacucccagcucaugacccugaaggacgccaugcugcagcuggacccgaacgccaagaccuggauggacaucgagggccgccccgaggaccccgucgagaucgcccucuaccagcccaucagcgggugcuacauccacuucuuccgggagccgacggaccugaagcaguucaagcaggacgcgaaguacucccacggcaucgacgugaccgaccuguucgccgcccagcccggccucaccagcgccgugaucgaggcccugccccgcaacauggucaucacgugccagggguccgacgacauccgcaagcuguucgagagccagggccggaaggacaucaagcucaucgacaucgcgcuguccaagaccgacagccgcaaguacgagaacgccgugugggaccaguacaaggaccugugccacaugcacaccggggucgugguggagaagaagaagaagggcgggaaggaggagaucacgccccacugcgcccucauggacugcaucauguucgacgccgcggucagcggcggccugaacacccuggugcuccgggccgugcugccgcgcgacauggucuuccggaccuccacccccaagguggugcuguga

SEQ ID NO: 1113 - RNA, 1710 nt, Artificial Sequence
  derived and/or modified CDS sequence (opt1) from Lassa virus__ANH09725__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucauccuggccgccgaccuggagaagcucaaguccaaggugacccggaccgagcgcccccugagcgccgggguguacaugggcaaccuguccagccagcagcucgaccagcggcgcgcgcugcugaacaugaucgggauguccggcggcaaccagggggcccgggccggccgcgacggggucgugcgggugugggacgucaagaacgccgaccuccugaacaaccaguucggcacgaugccgagccugacccucgcgugccugaccaagcagggccagguggaccugaacgacgugguccaggcccucaccgaccuggggcugaucuacacggccaaguaccccaacaccuccgaccucgaccgccugacccagagccaccccauccugaacaugaucgacaccaacaaguccagccucaacaucagcggcuacaacuucucccugggggccgccgugaaggcgggcgccugcaugcuggacgggggcaacaugcucgagacgaucaaggugagcccccagaccauggacggcauccugaaguccauccugaaggucaagaagucccucgggauguucaucagcgacaccccgggcgagcggaaccccuacgagaacauccuguacaagaucugccugagcggggacggcuggcccuacaucgccucccgcaccagcaucacggggcgggccugggagaacaccgugguggaccucgaguccggcggcaagccccagaaggccgggagcaacaacuccaacaagagccugcaguccgcgggcuucgccgccgggcugaccuacagccagcucaugacccugaaggacgccaugcugcagcuggacccgaacgccaagacguggauggacaucgagggccgccccgaggaccccgucgagaucgcgcucuaccagcccaucuccgggugcuacauccacuucuuccgggagccgaccgaccugaagcaguucaagcaggacgccaaguacagccacggcaucgacgugaccgaccuguucgccgcccagcccggccucaccuccgccgugaucgaggcgcugccccgcaacauggucaucacgugccaggggagcgacgacauccgcaagcugcucgagucccagggccggaaggacaucaagcugaucgacaucgcccugagcaagaccgacagccgcaaguacgagaacgccgugugggaccaguacaaggaccucugccacaugcacaccggggucgugguggagaagaagaagcggggcgggaaggaggagaucacgccccacugcgcccugauggacugcaucauguucgacgcggccgucuccggcggccugaacacccucgugcugcgcgccgugcugccgcgggacauggucuuccgcaccagcacccccaagguggugcucuga

SEQ ID NO: 1114 - RNA, 1710 nt, Artificial Sequence
  derived and/or modified CDS sequence (opt1) from Lassa virus__ANH09729__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacagcgaccugaagcgccugcgggaccucaaccaggccgucaacaaccugguggagcugaaguccacccagcagaaguccgugcuccgcgucggcacgcugaccuccgacgaccugcucacccuggccgccgaccuggagaagcucaagagcaaggugacccggacggagcgcccccuguccgccgggguguacaugggcaaccugagcucccagcagcucgaccagcggcgcgcgcugcugaacaugaucgggaugagcggcggcaaccagggggcccggaccggccgcgacggggucgugcgggugugggacgucaagaacgccgaccuccugaacaaccaguucggcaccaugccgucccugacccucgccugccugacgaagcagggccagguggaccugaacgacgugguccaggcgcucaccgaccuggggcugaucuacaccgccaaguaccccaacaccagcgaccucgaccgccugacgcagucccaccccauccugaacaugaucgacaccaacaagagcagccucaacaucuccggcuacaacuucagccugggggccgccgugaaggccggcgcgugcaugcuggacgggggcaacaugcucgagaccaucaaggugagcccccagaccauggacggcauccucaagagcauccugaaggucaagaagucccuggggauguucaucagcgacacgccgggcgagcggaaccccuacgagaacauccuguacaagaucugccuguccggggacggcuggcccuacaucgccagccgcaccuccaucaccgggcgggccugggagaacaccgugguggaccucgagagcggcggcaagccccagcgcgccggguccaacaacagcaacaagucccugcagagcgccggcuucgcggccgggcugacguacucccagcucaugacccugaaggacgccaugcugcagcuggacccgaacgccaagaccuggauggacaucgagggccggcccgaggaccccgucgagaucgcccucuaccagcccaccagcgggugcuacauccacuucuuccgcgagccgacggaccugaagcaguucaagcaggacgcgaaguacucccacggcaucgacgugaccgaccuguucgccgcccagcccggccucaccagcgccgugaucgaggcccugccccgcaacauggucaucacgugccagggguccgacgacauccggaagcugcucgagagccagggccgcaaggacaucaagcugaucgacaucgcgcugagcaagaccgacucccggaaguacgagaacgccgugugggaccaguacaaggaccucugccacaugcacaccggggucgugguggagaagaagaagaagggcgggaaggaggagaucacgccccacugcgcccugauggacugcaucauguucgacgccgcggucagcggcggccugaacacccucgugcugcgcgccgugcugccgcgggacauggucuuccgcaccuccacccccaagguggugcucuga

SEQ ID NO: 1115 - RNA, 1710 nt, Artificial Sequence
  derived and/or modified CDS sequence (opt1) from Lassa virus__ANH09731__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcugaaguccacccagcagaaguccgugcuccgcgucggcacgcugaccagcgacgaccugcucacccuggccgccgaccuggagaagcucaaguccaaggugacccggacggagcgcccccugagcgccgggguguacaugggcaaccuguccagccagcagcucgaccagcggcgcgcgcugcugaacaugaucgggaugaccggcggcaaccagggggcccggaccggccgcgacggggucgugcgggugugggacgucaagaacgccgaccuccugaacaaccaguucggcaccaugccgucccugacgcucgccugccugaccaagcagggccagguggaccugaacgacgugguccaggcgcucaccgaccuggggcugaucuacaccgccaaguaccccaacacgagcgaccucgaccgccugacccagucccaccccauccugaacaugaucgacaccaacaagagcucccucaacaucagcggcuacaacuucagccugggggccgccgugaaggccggcgcgugcaugcuggacgggggcaacaugcucgagaccaucaaggugagcccccagacgauggacggcauccucaagagcauccugaaggucaagaagucccuggggauguucaucagcgacaccccgggcgagcggaaccccuacgagaacauccuguacaagaucugccuguccggggacggcuggcccuacaucgccagccgcaccuccaucaccgggcgggccugggagaacacggugguggaccucgagagcggcggcaagccccagcgcgccggguccaacaacagcaacaagucccugcagagcgccggccuggcggccgggcucaccuacucccagcugaugacccugaaggacgccaugcugcagcucgacccgaacgccaagaccuggauggacaucgagggccggcccgaggaccccgucgagaucgcccuguaccagcccacgagcgggugcuacauccacuucuuccgcgagccgaccgaccugaagcaguucaagcaggacgcgaaguacucccacggcaucgacgugaccgaccucuucgccgcccagcccggccugaccagcgccgugaucgaggcccugccccgcaacauggucaucacgugccagggguccgacgacauccggaagcuccuggagagccagggccgcaaggacaucaagcugaucgacaucgcgcucuccaagaccgacagccggaaguacgagaacgccgugugggaccaguacaaggaccugugccacaugcacaccggggucgugguggagaagaagaagaagggcgggaaggaggagaucacgccccacugcgcccugauggacugcaucauguucgacgccgcggucagcggcggccucaacacccuggugcugcgcgccgugcucccgcgggacauggucuuccgcaccuccacccccaagguggugcuguga

SEQ ID NO: 1116 - RNA, 1710 nt, Artificial Sequence
  derived and/or modified CDS sequence (opt1) from Lassa virus__ANH09733__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaagcagcgccgggacgacaacgaccugaagcgccugcgggaccucaaccaggccgucaacaaccugguggagcucaagagcacccagcagaaguccgugcugcgcgucggcacgcugaccagcgacgaccugcucacccuggccgccgaccuggagaagcucaaguccaaggugacccggacggagcgcccccugagcgccgggguguacaugggcaaccuguccagccagcagcucgaccagcggcgcgcgcugcugaacaugaucgggauguccggcggcaaccagggggcccggaccggccgcgacggggucgugcgggugugggacgucaagaacgccgaccuccugaacaaccaguucggcaccaugccgagccugacccucgccugccugacgaagcagggccagguggaccugaacgacgugguccaggcgcucaccgaccuggggcugaucuacaccgccaaguaccccaacaccuccgaccucgaccgccugacgcagagccaccccauccugaacaugaucgacaccaacaaguccagccucaacaucagcggcuacaacuucucccugggggccgccgugaaggccggcgcgugcaugcuggacgggggcaacaugcucgagaccaucaaggugagcccccagaccauggacggcauccugaaguccauccugaaggucaagaagucccucgggauguucaucagcgacacgccgggcgagcggaaccccuacgagaacauccuguacaagaucugccugagcggggacggcuggcccuacaucgccucccgcaccagcaucaccgggcgggccugggagaacaccgugguggaccucgaguccggcggcaagccccagcgcgccgggagcaacaacuccaacaagagccugcaguccgccggcuucgcggccgggcugacguacagccagcucaugacccugaaggacgccaugcugcagcuggacccgaacgccaagaccuggauggacaucgagggccggcccgaggaccccgucgagaucgccuucuaccagcccaucuccgggugcuacauccacuucuuccgcgagccgaccgaccucaagcaguucaagcaggacgcgaaguacagccacggcaucgacgugacggaccuguucgccgcccagcccggccugaccuccgccgugaucgaggcccucccccgcaacauggucaucacgugccaggggagcgacgacauccggaagcugcuggagucccagggccgcaaggacaucaagcucaucgacaucgcgcugagcaagaccgacagccggaaguacgagaacgccgugugggaccaguacaaggaccugugccacaugcacaccggggucgugguggagaagaagaagaagggcgggaaggaggagaucacgccccacugcgcccucauggacugcaucauguucgacgccgcggucuccggcggccugaacacccuggugcuccgcgccgugcugccgcgggacauggucuuccgcaccagcacccccaagguggugcuguga

SEQ ID NO: 1117 - RNA, 1710 nt, Artificial Sequence
  derived and/or modified CDS sequence (opt1) from Lassa virus__ANH09735__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacgaacggcggccagggggcgaacgccggccgggacgggaucguccgcgugugggacgugaagaacgccgagcuccugaacaaccaguucggcaccaugcccucccugacccucgccugccugaccaagcaggggcaggucgaccugaacgacgcggugcaggcccucacggaccugggccugaucuacaccgccaaguaccccaacagcuccgaccucgaccggcugagccagaaccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagacgauggacggcauccugaaguccauccugaaggugaagcgcagccucgggauguucguguccgacaccccgggcgagcggaaccccuacgagaacauccuguacaagaucugccugagcggggacggcuggcccuacgucgccucccgcaccagcaucaucgggcgggccugggagaacaccgugguggaccucgaguccgacagcaagccccagcgcccgggcuccaaggagagcaaccggucccugcagacggccggcuuccccgcggggcugaccuacagccagcucaugacccugaaggacuccaugcugcagcuggaccccaacgccaagaccuggauggacaucgagggccgccccgacgacccggucgagaucgcccucuaccagcccagcuccgggugcuacauccacuucuuccgcgagcccacggaccugaagcaguucaagcaggacgccaaguacagccacggcaucgacaucggggaccuguucgccgcgcagcccggccucaccagcgccgugaucgaggcccugccgcggaacauggugaucacgugccagggcuccgaggacaucaagcgccugcucgagagccaggggcggaaggacauccgccuggucgacaucucccugagcaaggccgacucccggaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgcgcggugcugcccaaggacauggucuuccggaccagcacgccccgcguggugcuguga

SEQ ID NO: 1118 - RNA, 1710 nt, Artificial Sequence
  derived and/or modified CDS sequence (opt1) from Lassa virus__ANH09737__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacgaacggcggccagggggcgaacgccggccgggacgggaucguccgcgugugggacgugaagaacgccgagcuccugaacaaccaguucggcaccaugcccucccugacccucgccugccugaccaagcaggggcaggucgaccugaacgacgcggugcaggcccucacggaccugggccugaucuacaccgccaaguaccccaacagcuccgaccucgaccggcugagccagaaccaccccauccugaacaugaucgacaccaagaaguccagccucaacaucagcggcuacaacuucucccugggggccgccgugaaggcgggcgccugcaugcuggacgggggcaacaugcucgagaccaucaaggucagcccccagacgauggacggcauccugaaguccauccugaaggugaagcgcagccucgggauguucguguccgacaccccgggcgagcggaaccccuacgagaacauccuguacaagaucugccugagcggggacggcuggcccuacgucgccucccgcaccagcaucaucgggcgggccugggagaacaccgugguggaccucgaguccgacagcaagccccagcgcccgggcuccaaggagagcaaccggucccugcagacggccggcuuccccgcggggcugaccuacagccagcucaugacccugaaggacuccaugcugcagcuggaccccaacgccaagaccuggauggacaucgagggccgccccgacgacccggucgagaucgcccucuaccagcccagcuccgggugcuacauccacuucuuccgcgagcccacggaccugaagcaguucaagcaggacgccaaguacagccacggcaucgacaugggggaccuguucgccgcgcagcccggccucaccagcgccgugaucgaggcccugccgcggaacauggugaucacgugccagggcuccgaggacaucaagcgccugcucgagagccaggggcggcgcgacauccggcuggucgacaucucccugagcaaggccgacucccgcaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgggcggugcugcccaaggacauggucuuccgcaccagcacgccccggguggugcuguga

SEQ ID NO: 1119 - RNA, 1710 nt, Artificial Sequence
  derived and/or modified CDS sequence (opt1) from Lassa virus__ANH09739__NP
augagcgccuccaaggaggugaaguccuuccuguggacccagucccuccgccgggagcugagcggcuacugcuccaacaucaagcugcaggucgugaaggacgcccaggcgcuccugcacgggcuggacuucagcgagguguccaacauccagcgccucaugcggaaggagcgccgggacgacagcgaccugaagcgccugcgggaccucaaccaggccgucaacaaccugguggagcugaaguccacccagcagaaguccgugcuccgcgucggcacccugagcagcgacgaccugcucacccuggccgccgaccuggagaagcucaaguccaaggugauccggaccgagcgcccccugagcuccgggguguacaugggcaaccugagcacccagcagcucgaccagcggcgcgcccugcugaacaugaucgggaugacguccggcggccagggggcgaacgccggccgggacgggaucguccgcgugugggacgugaagaacgccgagcuccugaacaaccaguucggcaccaugcccagccugacccucgccugccugaccaagcaggggcaggucgaccugaacgacgcggugcaggcccucacggaccugggccugaucuacaccgccaaguaccccaacuccagcgaccucgaccggcugagccagaaccaccccauccugaacaugaucgacaccaagaaguccagccucaacaucuccggcuacaacuucagccugggggccgccgugaaggcgggcgccugcaugcuggacgggggcaacaugcucgagaccaucaaggucagcccccagacgauggacggcauccucaagagcauccugaaggugaagcgcucccuggggauguucgugagcgacaccccgggcgagcggaaccccuacgagaacauccuguacaagaucugccuguccggggacggcuggcccuacgucgccagccgcaccuccaucaucgggcgggccugggagaacaccgugguggaccucgagagcgacuccaagccccagcgcccgggcagcaaggaguccaaccggagccugcagacggccggcuuccccgcggggcugaccuacucccagcucaugacccugaaggacagcaugcugcagcuggaccccaacgccaagaccuggauggacaucgagggccgccccgacgacccggucgagaucgcccucuaccagcccuccagcgggugcuacauccacuucuuccgcgagcccacggaccugaagcaguucaagcaggacgccaaguacagccacggcaucgacaucggggaccuguucgccgcgcagcccggccucaccuccgccgugaucgaggcccugccgcggaacauggugaucacgugccagggcagcgaggacaucaagcgccugcucgagucccaggggcggcgcgacauccggcuggucgacaucagccuguccaaggccgacagccgcaaguucgagaacgccgugugggaccaguucaaggaccucugcaacaugcacaccggcgucgugguggagaagaagaagaagggcgggaaggaggagaucaccccgcacugcgcgcugauggacugcaucauguucgacgccgccgucaugggcgggcuggacgccaaggugcuccgggcggugcugcccaaggacauggucuuccgcaccuccacgccccggguggugcuguga

SEQ ID NO: 1120 - RNA, 1710 nt, Artificial Sequence
  derived and/or modified CDS sequence (opt1) from Lassa virus__ANH09741__NP
augagcaacuccaaggaggugaaguccuuccuguggacccagagccuccgccgggagcugagcggcuacugcaccaacaucaagcugcaggucgugaaggacgcccaggcccuccugcacgggcuggacuucuccgaggugagcaacguccagcgccucaugcggaagcagaagcgcgacgacaacgaccugaagcggcugcgcgaccucaaccaggcggugaacaaccugguggagcugaaguccguccagcagaaguccgugcucaaggugggcacgcugaacagcgacgaccugcucacccuggccgccgaccuggagaagcucaagagcaaggucgugcggaccgagcgcccccuguccagcgggguguacaugggcaaccuguccagccagcagcucgaccagcggcgcgcccugcugaacaugaucgggauggccggcggcucccaggggaaccagccgagccgggacggcgucgugcgcgugugggacgucaagaacgcggaccuccugaacaaccaguucgggaccaugcccucccugacgcucgccugccugaccaagcagggccagguggaccugaacgacgugguccucgcccugaccgaccuggggcucaucuacaccgccaaguaccccaacagcuccgaccuggaccggcugagccagaaccaccccgugcucaacaugaucgacgugaacaagagcucccugaacaucagcggcuacaacuucucccugggcgcggccgucaaggccggggccugcaugcucgacggcgggaacaugcuggagacgaucaagaucagcccgcagaccguggacggcauccugaaguccauccucaaggugaagcgcgcccugggcauguucgucagcgacacccccggggagcggaaccccuacgagaacauccuguacaaggugugccucuccggcaacggguggcccuacaucgcgagccgcaccuccaucgucggccgggccugggagaacacggugguggaccuggagagcaacaagaaccagccgaaggucgggaacaacggcuccaacaagaugcugcagagcuccggcuucgccaccgggcucaccuacagccagcugaugacccugcgcgacuccaugcugcagcucgaccccacggccaagaccuggaucgacaucgagggccggcccgaggaccccguggagcuggcccuguuccagccgagcuccgggugcuacauccacuucuuccgcgagcccaccgaccucaagcaguucaagcaggacgcgaaguacagccacggcaucgacgugaacgaccuguucuccgcccagcccgggcugaccagcgccguccucgaggcccugccccggaacauggugcugacgugccagggcagcgacgacauccgcaagcuccuggacucccaggaccgcaaggacaucaagcugaucgacaucagccucuccaaggccgacgcgcggaaguucgagaacgacgugugggaccaguucaaggaccugugccacaugcacaccggcaucgucguggagaagaagaagaagggcgggaagcaggagaugaccccgcacugcgcccugcucgacugcaucauguucgacgccgccgugagcgggggccugaacguccccacccugcgcgccgugcuccccacggacaugguguuccggaccaucaccaccaaggucgugcuguga

SEQ ID NO: 1121 - RNA, 1713 nt, Artificial Sequence
  derived and/or modified CDS sequence (opt1) from Lassa virus__CAA36646__NP
augagcgccuccaaggaggugcgcagcuuccuguggacccagucccuccggcgcgagcugagcggcuacugcuccaacaucaagcugcaggucgugaaggacgcccaggcgcuccugcacgggcuggacuucagcgagguguccaacguccagcggcucaugcgcaagcagaagcgggacgacggcgaccugaagcgccugcgggaccucaaccaggccgugaacaaccugguggagcucaagagcacccagcagaaguccguccugcgcguggggacccugagcuccgacgaccugcucauccuggccgccgaccuggagaagcucaagagcaaggugacccggaccgagcgcccccuguccagcggcgucuacauggggaaccuguccagccagcagcucgaccagcggcgcgcccugcugaacaugaucggcaugaccggcguguccgggggcgggaagggcgcgagcgacgggaucgugcgggucugggacgugaagaacgccgagcuccugaacaaccaguucggcacgaugccgucccugacccucgccugccugaccaagcagggccagguggaccugaacgacgccguccaggcgcucaccgaccuggggcugaucuacacggccaaguaccccaacagcagcgaccucgaccgccugucccagagccaccccauccugaacaugaucgacaccaagaaguccagccucaacaucuccggcuacaacuucagccugggggccgccgugaaggccggcgcgugcaugcuggacggcgggaacaugcucgagaccaucaaggugagcccccagaccauggacggcauccucaaguccauccugaaggucaagaagucccuggggauguucgugagcgacacgccgggcgagcggaaccccuacgagaacauccuguacaagaucugccuguccggggacggcuggcccuacaucgccagccgcaccuccaucgugggccgggccugggagaacaccgucguggaccucgagcaggacaacaagccccagaagaucgggaacggcgggagcaacaagucccugcagagcgccggcuucgccgcggggcugaccuacucccagcucaugacgcugaaggacuucaagugcuucaaccugaucccgaacgccaagaccuggauggacaucgagggccgccccgaggaccccguggagaucgcccuguaccagcccagcuccggcugcuacguccacuucuuccgggagccgaccgaccucaagcaguucaagcaggacgccaaguacagccacgggaucgacgugaccgaccuguucgccgcgcagcccggccugacgagcgccgucaucgaggcccucccccgcaacauggugaucacgugccagggguccgaggacauccggaagcugcuggagagccagggccgccgcgacaucaagcucaucgacaucacccuguccaaggccgacagccggaaguucgagaacgccgugugggaccaguucaaggaccugugccacaugcacaccggggucgugguggagaagaagaagcgcggcggcaaggaggagaucacgccccacugcgcgcucauggacugcaucauguucgacgccgccgucuccgggggccuggacgccaaggugcugcgggugguccucccgcgcgacaugguguuccggaccagcacccccaaggugguccuguga

SEQ ID NO: 1122 - RNA, 1710 nt, Artificial Sequence
  derived and/or modified CDS sequence (opt1) from Lassa virus__CCA30315__NP
augagcgccuccaaggaggugaaguccuuccuguggacccagagccuccgccgggagcugagcggcuacugcuccaacaucaagcugcaggucgugaaggacgcccaggcgcuccugcacgggcuggacuucagcgagguguccaacguccagcgccucaugcggaagcagcgccgggacgacagcgaccugaagcgccugcgggaccucaaccaggccgugaacaaccugguggagcugaaguccacccagcagaaguccguccuccgcgugggcacgcugagcagcgacgaccugcucacccuggccgccgaccuggagaagcucaaguccaaggugacccggaccgagcgcccccugagcuccggggucuacaugggcaaccugagcucccagcagcucgaccagcggcgcgcccugcugaaccucaucgggaugacgaacggcagccagggcucccaggcggggcgggacggcguggugcgcgucugggacgugaagaacgccgagcugcugaacaaccaguucgggaccaugccgagccucacccuggccugccugaccaagcagggccagguggaccucaacgacgucgugcaggcccugacggaccuggggcucaucuacaccgcgaaguaccccaacaccagcgaccuggaccggcugacccagucccaccccauccucaacaugaucgacacgaagaaguccagccugaacaucagcggcuacaacuucucccugggcgccgccgugaaggccggggccugcaugcucgacggcgggaacaugcuggagaccaucaaggucagcccccaguccauggacggcauccucaagagcauccugaaggugaagcgcgcgcugggcauguucguguccgacaccccgggggagcggaaccccuacgagaacauccuguacaagaucugccucagcggcgacggguggcccuacaucgccucccgcaccagcaucgucggccgggccugggagaacacggugguggaccuggagaccgacgggaagccccagaagaucggcuccggcaacagcaacaagucccugcagagcgccggguucuccgccggccucaccuacagccagcugaugacccugaaggacgcgaugcugcagcucgacccgaacgccaagacguggauggacaucgaggggcgccccgaggaccccgucgagguggcccuguaccagcccaucuccggcugcuacauccacuucuuccgggagccgaccgaccugaagcaguucaagcaggacgccaaguacagccacgggaucgacaucgccgaccucuucgcggcccagcccggccugaccagcgccgucaucgaggcccugccccgcaacauggugaucacgugccagggcuccgaggacaucaagaagcuccuggagagccaggggcgcaaggacaucaagcugaucgacaucgcccucuccaagaucgacagccggaaguucgagaacgcggugugggaccaguacaaggaccugugccacaugcacaccggcgucgugguggagaagaagaagcgcgggggcaaggaggagaucaccccgcacugcgcccugauggacugcaucauguucgacgccgccgucuccgggggccucaacacccuggugcugcgggcggugcucccccgcgacauggucuuccggaccagcacgccccgcguggugcuguga

SEQ ID NO: 1123 - RNA, 1710 nt, Artificial Sequence
  derived and/or modified CDS sequence (opt1) from Lassa virus__JX985061__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcuccgguccaaggucauccgcaccgagcggccccugagcgccgggguguacaugggcaaccuguccagccagcagcucgaccagcgccgggcgcugcugaacaugaucgggauguccggcggcaaccagggggcccgcgccggccgggacggggugguccgcgugugggacgugaagaacgccgagcuccugagcaaccaguucggcaccaucccgucccugacgcucgcgugccugaccaagcaggggcaggucgaccugaacgacgccgugcaggcccucaccgaccugggccugaucuacaccgccaaguaccccaacacgagcgaccucgaccggcugacccagucccaccccauccugaacaugaucgacaccaagaaguccagccucaacaucuccggcuacaacuucagccugggggccgcggugaaggccggcgccugcaugcuggacgggggcaacaugcucgagaccaucaaggucagcccccagacgauggacggcauccucaagagcauccugaaggugaagaaggcccuggggauguucaucuccgacaccccgggcgagcgcaaccccuacgagaacauccuguacaagaucugccugagcggggacggcuggcccuacaucgccucccggaccagcaucaccgggcgcgcgugggagaacacgguggucgaccucgaguccgacggcaagccccagaaggccgacagcaacaacuccagcaagucccugcagagcgccggcuucaccgccgggcugaccuacucccagcucaugacccugaaggacgccaugcugcagcuggacccgaacgcgaagacguggauggacaucgagggccggcccgaggaccccguggagaucgcccucuaccagcccagcuccgggugcuacauccacuucuuccgcgagccgaccgaccugaagcaguucaagcaggacgccaaguacagccacggcaucgacgugaccgaccuguucgccacccagcccgggcucacguccgccgucaucgacgcgcugccccgcaacauggugaucacgugccagggcagcgacgacauccggaagcugcucgagagccagggccgcaaggacaucaagcugaucgacaucgaccuguccaagaccgacagccggaaguacgagaacgccgugugggaccaguacaaggaccucugccacaugcacaccggggucguggucgagaagaagaagcgcggcgggaaggaggagaucaccccgcacugcgcccugauggacugcaucauguucgacgccgcgguguccggcgggcugaacaccagcgugcuccgggccguccugccccgcgacaugguguuccggaccuccacgccccgcgugguccuguga

SEQ ID NO: 1124 - RNA, 1710 nt, Artificial Sequence
  derived and/or modified CDS sequence (opt1) from Lassa virus__NP_694869__NP
augagcgccuccaaggagaucaagagcuuccuguggacccagucccuccgccgggagcugagcggcuacugcuccaacaucaagcuccagguggucaaggacgcccaggcgcugcugcacgggcuggacuucagcgagguguccaacgugcagcgccucaugcggaaggagcgccgggacgacaacgaccugaagcgccugcgggaccucaaccaggccgucaacaaccugguggagcucaagagcacccagcagaaguccauccugcgcgugggcacccugaccagcgacgaccugcucauccuggccgccgaccuggagaagcucaaguccaaggucauccggaccgagcgcccccugagcgccgggguguacaugggcaaccuguccagccagcagcucgaccagcggcgcgcgcugcugaacaugaucgggauguccggcggcaaccagggggcccgggccggccgcgacggggugguccgggugugggacgugaagaacgccgagcuccugaacaaccaguucggcaccaugccgagccugacgcucgcgugccugaccaagcaggggcaggucgaccugaacgacgccgugcaggcccucaccgaccugggccugaucuacaccgccaaguaccccaacacguccgaccucgaccgccugacccagagccaccccauccugaacaugaucgacaccaagaaguccagccucaacaucagcggcuacaacuucucccugggggccgcggugaaggccggcgccugcaugcuggacgggggcaacaugcucgagaccaucaaggucagcccccagacgauggacggcauccugaaguccauccugaaggugaagaaggcccucgggauguucaucagcgacaccccgggcgagcggaaccccuacgagaacauccuguacaagaucugccuguccggggacggcuggcccuacaucgccagccgcaccuccaucaccgggcgggcgugggagaacacgguggucgaccucgagagcgacggcaagccccagaaggccgacuccaacaacagcuccaagagccugcaguccgccggcuucaccgccgggcugaccuacagccagcucaugacccugaaggacgccaugcugcagcuggacccgaacgcgaagacguggauggacaucgagggccgccccgaggaccccguggagaucgcccucuaccagcccuccagcgggugcuacauccacuucuuccgggagccgaccgaccugaagcaguucaagcaggacgccaaguacucccacggcaucgacgugaccgaccuguucgccacccagcccgggcucacgagcgccgucaucgacgcgcugccccgcaacauggugaucacgugccagggcuccgacgacauccgcaagcugcucgagagccagggccggaaggacaucaagcugaucgacaucgcccugagcaagaccgacucccgcaaguacgagaacgccgugugggaccaguacaaggaccucugccacaugcacaccggggucguggucgagaagaagaagcggggcgggaaggaggagaucaccccgcacugcgcccugauggacugcaucauguucgacgcggccgugagcggcgggcugaacaccuccgugcuccgcgccguccugccccgggacaugguguuccgcaccagcacgccccgggugguccuguga

SEQ ID NO: 1125 - RNA, 1710 nt, Artificial Sequence
  derived and/or modified CDS sequence (opt1) from Lassa virus__SCA79106__NP
augagcaacuccaaggaggugaaguccuuccuguggacccagagccuccgccgggagcugagcggcuacugcuccaacaucaagcugcaggucgugaaggacgcccaggcccuccugcacgggcuggacuucagcgagguguccaacguccagcgccucaugcggaagcagaagcgcgacgacggcgaccugaagcggcugcgcgaccucaaccaggcggugaacaaccugguggagcucaagagcguccagcagaaguccauccugcggguggggacccugaccagcgacgaccugcucacccuggccgccgaccuggagaagcucaaguccaaggugacccgcaccgagcggccccugagcuccggcgucuacauggggaaccugagcucccagcagcucgaccagcgccgggcccugcugagcaugaucggcauguccggcgggaaccagaacagccagccgaagggcgacgggguggugcgcgucugggacgugaagaacgccgaccuccugaacaaccaguucggcacgaugcccucccugacccucgcgugccugaccaagcagggccagguggaccugaacgacgccguccaggcccucaccgaccuggggcugaucuacacggccaaguaccccaacagcagcgaccucgaccggcugucccagagccaccccauccugaacaugaucgacaccaagaaguccagccucaacaucuccggcuacaacuucagccugggggcggccaucaagaccggcgccugcaugcuggacgggggcaacaugcucgagaccaucaaggugacgccgcagaccauggacggcauccugaaguccauccugaaggugaagcgcagccucgggauguucaucuccgacacccccggcgagcggaaccccuacgagaacauccuguacaagaucugccugagcggggacggcuggcccuacaucgccucccgcaccgccaucaucgggcgggcgugggagaacacggucguggaccucgagagcgacuccaagccgcagaagaucggcagcaacggcuccaacaagagccugcaguccgccggguucgcccccggccugaccuacagccagcucaugacccugaaggacuccaugcugcagcuggaccccaacgccaagaccuggaucgacaucgaggggcgccccgaggacccgguggaggucgcccucuuccagcccaucagcggcugcuacauccacuucuuccgggagcccacggaccugaagcaguucaagcaggacgcgaaguacagccacgggaucgacgugaccgaccuguucgccgcccagcccggccucaccuccgccgugaucgaggcccugccgcgcaacaugguccugaccugccagggcagcgacgacaucaagaagcuccuggacucccaggggcggcgcgacaucaagcugaucgacgugagccucaacaagaucgacucccgcaaguucgagaacgcggucugggaccaguacaaggaccugugccacaugcacacgggcgugguggucgagaagaagaagaagggcgggaaggaggagaucacgccccacugcgcccugcucgacugcaucauguucgacgccgccgugagcgggggccugaacgccaccgugcugcgggcgguccucccccgcgacaugguguuccggaccuccagccccaaggugguccuguga

SEQ ID NO: 1126 - RNA, 1473 nt, Artificial Sequence
  derived and/or modified CDS sequence (opt2) from Lassa virus__AAF86703__GPC
augggccagaucaucaccuucuuccaggaggucccccacgucaucgaggaggucaugaacaucguccucaucgcccucucccuccucgccauccucaagggcaucuacaacgucgccaccugcggccucuucggccucaucuccuuccuccuccucugcggccgcuccugcuccgucaccuacaagggcgucuacgagcuccagacccucgagcucaacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuucgccgucgacgccgccaaccacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgaggcccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucaagcgccucaagaccgaggcccagauguccauccagcucaucaacaaggccgucaacgcccucaucaacgaccagcucaucaugaagaaccaccuccgcgacaucaugggcauccccuacugcaacuacucccgcuacugguaccucaaccacaccgucaccggcaagaccucccucccccgcugcuggcucgucuccaacggcuccuaccucaacgagacccacuucuccgacgacaucgagcagcaggccgacaacaugaucaccgagaugcuccagaaggaguacauggaccgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcaccccggcguccccgucaaguggaagcgcuga

SEQ ID NO: 1127 - RNA, 1476 nt, Artificial Sequence
  derived and/or modified CDS sequence (opt2) from Lassa virus__AAG41802__GPC
augggccagaucgucaccuucuuccaggaggucccccacgucaucgaggaggucaugaacaucguccucaucgcccucuccauccucgccguccucaagggccucuacaacaucgccaccugcggccucaucggccucaucaccuuccuccuccucugcggccgcuccugcuccuccaaccucuacaagggcgucuacgagcuccagucccucgaccucaacauggagacccucaacaugaccaugccccucuccugcaccaagaacaacucccaccacuacauccgcgucggcaacgacaccggccucgagcucacccucaccaacaccuccauccucaaccacaaguucugcaaccucuccgacgcccacaagaaggaccucuacgaccacgcccucauguccaucaucuccaccuuccaccucuccauccccaacuucaaccaguacgaggccauguccugcgacuucaacggcggcaagaucuccguccaguacaaccucucccacuccuacgccaucgacgccgccaaccacugcggcaccgucgccaacggcauccuccagaccuucaugcgcauggccuggggcggcuccuacaucgcccucgacuccggccgcggcaacugggacugcaucaugaccuccuaccaguaccucaucauccagaacaccaccugggagaaccacugccaguucucccgccccucccccaucggcuaccucggccuccucucccagcgcacccgcgacaucuacaucucccgccgccuccucggcaccuucaccuggacccucuccgacuccgagggcaacgccacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucucccgccucaaguccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccgccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1128 - RNA, 1473 nt, Artificial Sequence
  derived and/or modified CDS sequence (opt2) from Lassa virus__AAL13212__GPC
augggccagaucgucaccuucuuccaggaggucccccacgucaucgaggagaucaugaacaucguccucaucacccucucccuccucgccauccucaagggcgucuacaaccucgccaccugcggccucaucggccucaucaccuuccucuuccucugcggccgcuccugcuccaugaccuacaagggcuccuaccagcucgagacccucgagcucaacauggagacccucaacaugaccaugccccucuccugcaccaagaacaccucccaccacuacauccgcgucggcaacgagaccggccucgagcucacccucaccaacaccuccaucaucaaccacaaguucugcaaccucuccgacgcccacaagaagaaccucuacgaccacucccucauguccaucaucuccaccuuccaccucuccauccccaacuucaaccaguacgaggccauguccugcgacuucaacggcggcaagaucuccauccaguacaaccucucccacaccuacgccggcgacgccgccaagcacugcggcacccucgccaacggcauccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgagaucuacaucucccgccgccuccucggcaccuucaccuggacccucuccgacuccgagggcaacgagaaccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccucccccgcugcuggcucgucuccaacggcuccuaccucaacgagacccgcuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucaucaagauccccacccaccgccacaucgucggcggccccugccccaagccccaccgccucaaccacaagggcaucugcuccugcggccucuacaagcgccccggcgucuccguccgcuggaagcgcuga

SEQ ID NO: 1129 - RNA, 1476 nt, Artificial Sequence
  derived and/or modified CDS sequence (opt2) from Lassa virus__AAO59512__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucgccuuccuccuccucugcggccgcuccugcaccuccucccucuacaagggcgucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaagcacugcggcaccgucgccaacggcguccuccagaccuucaugcgcauggccuggggcggcuccuacaucgcccucgacuccggccacggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacucccgcuacugguaccucaaccacaccaccaccggcaagaccucccuccccaagugcuggcucgucuccaacggcuccuaccucaacgagacccgcuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1130 - RNA, 1476 nt, Artificial Sequence
  derived and/or modified CDS sequence (opt2) from Lassa virus__AAT49000__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccucuuccucugcggccgcuccugcuccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucgucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaaccucaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggcgucuacaagcagcccggcguccccguccgcuggaagcgcuga

SEQ ID NO: 1131 - RNA, 1476 nt, Artificial Sequence
  derived and/or modified CDS sequence (opt2) from Lassa virus__AAT49004__GPC
augggccagaucgucaccuucuuccaggaggucccccacgucaucgaggaggucaugaacaucguccucaucgcccucuccguccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1132 - RNA, 1476 nt, Artificial Sequence
  derived and/or modified CDS sequence (opt2) from Lassa virus__AAT49008__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccucuuccucugcggccgcuccugcuccaccacccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacucccgcuacugguaccucaaccacaccgucaccggcaagaccucccuccccaagugcuggcucgucuccaacggcuccuaccucaacgagacccacuucuccgacgacaucgagcagcaggccgacaaccucaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggcgucuacaagcagcccggcguccccguccgcuggaagcgcuga

SEQ ID NO: 1133 - RNA, 1473 nt, Artificial Sequence
  derived and/or modified CDS sequence (opt2) from Lassa virus__AAT49010__GPC
augggccagaucgucaccuucuuccaggaggucccccacgucaucgaggaggucaugaacaucguccucaucgcccucuccguccucgccauccucaagggccucuacaacuucgccaccugcggccucaucggccucgucaccuuccuccuccucuccggccgcuccugcuccaugaucuacaagggcgucuacgagcuccagacccucgagcucaacauggagacccucaacaugaccaugccccucuccugcaccaagaacaccucccaccacuacauccgcgucggcaacgacaccggccucgagcucacccucaccaacgagacccuccuccaccacaaguucugcaaccucuccgacgcccacaagcgcaaccucuacgaccacgcccucauguccaucaucuccaccuuccaccucuccauccccaacuucaaccaguacgaggccauguccugcgacuucaacggcggcaagaucaccguccaguacaaccucucccacuccuacgccgucgacgccgccaagcacugcggcaccgucgccaacggcguccuccagaccuucaugcgcauggccuggggcggcuccuacaucgcccucgacucccgccacggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccuccaccggcaagaccucccucccccgcugcuggcucgucuccaacggcuccuaccucaacgagacccacuucuccgacgacaucgagcagcaggccgacaacaugaucaccgagaugcuccagaaggaguaccucgaccgccagggcaagaccccccucggccucgucgaccucuucgucuucuccaccuccuucuaccucaucuccaucuuccuccaccucaucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1134 - RNA, 1473 nt, Artificial Sequence
  derived and/or modified CDS sequence (opt2) from Lassa virus__AAT49014__GPC
augggccagaucaucaccuucuuccaggaggucccccacgucaucgaggaggucaugaacaucguccucaucgcccucucccuccucgccauccucaagggccucuacaacaucgccaccugcggcaucaucggccucgucgccuuccucuuccucugcggcaaguccugcucccucacccucaagggcggcuacgagcuccagacccucgagcucaacauggagacccucaacaugaccaugccccucuccugcaccaagaacuccucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccgagcacugcggcaccgucgccaacggcguccuccagaccuucaugcgcauggccuggggcggccgcuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccuccuccggccgcaccucccuccccaagugcuggcucaucuccaacggcuccuaccucaacgagacccaguucuccgacgacaucgagcagcaggccgaccacaugaucaccgagaugcuccagaaggaguacaucgagcgccagggcaagaccccccucggccucgucgacaucuucaucuucuccaccuccuucuaccucaucuccaucuuccuccaccucaucaagauccccacccaccgccacaucgucggcaagcccugccccaagccccaccgccucaaccacaugggcgucugcuccugcggccucuacaagcaccccggcguccccaccaaguggaagcgcuga

SEQ ID NO: 1135 - RNA, 1476 nt, Artificial Sequence
  derived and/or modified CDS sequence (opt2) from Lassa virus__AAV54104__GPC
augggccagaucgucaccuucuuccaggaggucccccacgucaucgaggaggucaugaacaucguccucaucgcccucuccguccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcgaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1136 - RNA, 1476 nt, Artificial Sequence
  derived and/or modified CDS sequence (opt2) from Lassa virus__ADI39451__GPC
augggccagaucgucaccuucuuccaggaggucccccacgucaucgaggaggucaugaacaucguccucaucgcccucuccguccucgccguccucaagggccucuacaacgucgccaccugcggccucaucggccucaucgccuuccuccuccucugcggccgcuccugcaccaccacccucuacaagggcgucuacgagcuccaggcccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccgucgccaacggcguccuccagaccuucaugcgcauggccuggggcggcuccuacaucgcccucgacuccggccgcggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggccgcaccucccuccccaagugcuggcucgucuccaacggcuccuaccucaacgagacccacuucuccgacgacaucgagcagcaggccgacaacaugaucaccgagaugcuccagaaggaguacaucgagcgccagggcaagaccccccucggccucgucgaccucuucgucuucuccaccuccuucuaccucaucuccaucuuccuccaccucaucaagauccccacccaccgccacaucgucaacaagcccugccccaagccccaccgccucaaccacaugggcgucugcuccugcggccucuacaagcagcccggcguccccguccgcuggaagcgcuga

SEQ ID NO: 1137 - RNA, 1473 nt, Artificial Sequence
  derived and/or modified CDS sequence (opt2) from Lassa virus__ADU56610__GPC
augggccagaucgucaccuucuuccaggaggucccccacgucaucgaggaggucaugaacaucguccucaucgcccucucccuccucgccauccucaagggcaucuacaacgucgccaccugcggccucuucggccucaucuccuuccuccuccucugcggccgcuccugcuccaccaccuacaagggcgucuacgagcuccagacccucgagcucgacauggccaaccucaacaugaccaugccccucuccugcaccaagaacuccucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgaggcccccggcggcuacugccucacccgcuggaugcucaucgaggccgagcucaagugcuucggcaacaccgccaucgccaagugcaacgagaagcacgacgaggaguucugcgacaugcuccgccucuucgacuucaacaagcaggccaucaagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucaucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucgucggccgccccugccccaagccccaccgccucaaccacaugggcaucugcuccugcggccucuacaagcaccccggcguccccgucaaguggaagcgcuga

SEQ ID NO: 1138 - RNA, 1473 nt, Artificial Sequence
  derived and/or modified CDS sequence (opt2) from Lassa virus__ADU56618__GPC
augggccagaucgucaccuucuuccaggaggucccccacgucaucgaggaggucaugaacaucguccucaucgcccucuccauccucgccauccucaagggccucuacaacaucgccaccugcggccucaucggccucgucaccuuccuccuccucuccggccgcuccugcuccaugaccuacaagggcgucuacgagcuccagacccucgagcucaacaugaacacccucaacaugaccaugccccucuccugcaccaagaacaacucccaccacuacaucauggucggcaacgagaccggccucgagcucacccucaccaacaccucccuccuccaccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucaccguccaguacaaccucucccacuccuacgccaucgacgccgccaaccacugcggcaccgucgccaacggcguccuccagaccuucaugcgcauggccuggggcggcuccuacaucgcccucgacuccggccgcggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccuccaccggccgcaccucccucccccgcugcuggcucgucuccaacggcuccuaccucaacgagacccacuucuccgacgacaucgagcagcaggccgacaacaugaucaccgagaugcuccagaaggaguaccucgaccgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1139 - RNA, 1473 nt, Artificial Sequence
  derived and/or modified CDS sequence (opt2) from Lassa virus__ADU56622__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1140 - RNA, 1473 nt, Artificial Sequence
  derived and/or modified CDS sequence (opt2) from Lassa virus__ADU56626__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucaacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagcgcaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaagcacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1141 - RNA, 1473 nt, Artificial Sequence
  derived and/or modified CDS sequence (opt2) from Lassa virus__ADU56630__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucguccgcauccccacccaccgccacgucaucggcaagcccugccccaagccccaccgccucaaccacaugggcaucugcuccugcggccucuacaagcaccccggcguccccgucaaguggaagcgcuga

SEQ ID NO: 1142 - RNA, 1476 nt, Artificial Sequence
  derived and/or modified CDS sequence (opt2) from Lassa virus__AFY05588__GPC
augggccagaucgucaccuucuuccaggaggucccccacgucaucgaggaggucaugaacaucguccucaucgcccucuccguccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgaccucuacaucucccgccgccuccucggcaccuucaccuggacccucuccgacuccgagggcgaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1143 - RNA, 1476 nt, Artificial Sequence
  derived and/or modified CDS sequence (opt2) from Lassa virus__AFY05590__GPC
augggccagaucgucaccuucuuccaggaggucccccacgucaucgaggaggucaugaacaucguccucaucgcccucuccguccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacauguacaucucccgccgccuccucggcaccuucaccuggacccucuccgacuccgagggcgaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1144 - RNA, 1476 nt, Artificial Sequence
  derived and/or modified CDS sequence (opt2) from Lassa virus__AHC95553__GPC
augggccagaucgucaccuucuuccaggaggucccccacgucaucgaggaggucaugaacaucguccucaucgcccucuccauccucgccguccucaagggccucuacaacaucgccaccugcggccucaucggccucgucaccuucuuccuccucugcggccgcuccugcuccuccaaccucuacaagggcgucuacgagcuccagucccucgaccucaacauggagacccucaacaugaccaugccccucuccugcaccaagaacaacucccaccacuacauccgcgucggcaacgagaccggccucgagcucacccucaccaacaccucccuccucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucaccguccaguacaaccucucccacuccuacgccggcgacgccgcccgccacugcggcaccaucgccaacggcguccuccagaccuucaugcgcauggccuggggcggcuccuacaucgcccucgacuccggccacggcaacugggacugcaucaugaccuccuaccaguaccucaucauccagaacaccaccugggaggaccacugccaguucucccgccccucccccaucggcuaccucucccuccucucccagcgcacccgcgacaucuacaucucccgccgccuccucggcaccuucaccuggacccucuccgacuccgagggcaacgccacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucucccgccuccgcuccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccuccccaagugcuggcucgucuccaacggcuccuaccucaacgagacccacuucuccgacgacaucgagcagcaggccgacaacaugaucaccgagaugcuccagaaggaguacauggaccgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccgcaugggcaucugcuccugcggccucuacaagcagcccggcguccccgucaaguggaagcgcuga

SEQ ID NO: 1145 - RNA, 1476 nt, Artificial Sequence
  derived and/or modified CDS sequence (opt2) from Lassa virus__AHC95555__GPC
augggccagaucgucaccuucuuccaggaggucccccacgucaucgaggaggucaugaacaucguccucaucgcccucuccauccucgccguccucaagggccucuacaacaucgccaccugcggccucaucggccucgucaccuuccuccuccucugcggccgcuccugcuccuccaaccucuacaagggcgucuacgagcuccagucccucgaccucaacauggagacccucaacaugaccaugccccucuccugcaccaagaacaacucccaccacuacauccgcgccggcaacgagaccggccucgagcucacccucaccaacaccucccucaucaaccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacgccuacgccaucgacgccgccgagcacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgccacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucucccgccucaaguccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggccgcaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcgucccccucaaguggaagcgcuga

SEQ ID NO: 1146 - RNA, 1476 nt, Artificial Sequence
  derived and/or modified CDS sequence (opt2) from Lassa virus__AHC95557__GPC
augggccagaucgucaccuucuuccaggaggucccccacgucaucgaggaggucaugaacaucguccucaucgcccucuccauccucgccguccucaagggccucuacaacaucgccaccugcggccucaucggccucgucaccuucuuccuccucugcggccgcuccugcuccuccaaccucuacaagggcgucuacgagcuccagucccucgaccucaacauggagacccucaacaugaccaugccccucuccugcaccaagaacaacucccaccacuacauccgcgucggcaacgagaccggccucgagcucacccucaccaacaccucccuccucaaccacaaguucugcaaccucuccgacgcccacaagcgcaaccucuacgaccacgcccucauguccaucaucuccaccuuccaccucuccauccccaacuucaaccaguacgaggccauguccugcgacuucaacggcggcaagaucaccguccaguacaaccucucccacuccuacgccggcgacaccgccaagcacugcggcaccaucgccaacggcguccuccagaccuucaugcgcauggccuggggcggcuccuacaucgcccucgacuccggccacggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgccacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucucccgccuccgcuccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccuccccaagugcuggcucgucuccaacggcuccuaccucaacgagacccacuucuccgacgacaucgagcagcaggccgacaacaugaucaccgagaugcuccagaaggaguacauggaccgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccgcaugggcaucugcuccugcggccucuacaagcagcccggcguccccgucaaguggaagcgcuga

SEQ ID NO: 1147 - RNA, 1476 nt, Artificial Sequence
  derived and/or modified CDS sequence (opt2) from Lassa virus__AHC95559__GPC
augggccagaucaucaccuucuuccaggaggucccccacgucaucgaggaggucaugaacaucguccucaucgcccucuccauccucgccguccucaagggccucuacaacaucgccaccugcggccucaucggccucgucaccuuccuccuccucugcggccgcuccugcuccuccucccucuacaagggcgucuacgagcuccagucccucgaccucaacauggagacccucaacaugaccaugccccucuccugcaccaagaacaacucccaccacuacauccgcgucggcaacgagaccggccucgagcucacccucaccaacaccucccucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccaucgacgccgccucccacugcggcaccgucgccaacggcguccuccagaccuucaugcgcauggccuggggcggcuccuacaucgcccucgacuccggccacggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgccacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucucccgccucaaguccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1148 - RNA, 1476 nt, Artificial Sequence
  derived and/or modified CDS sequence (opt2) from Lassa virus__AIT17126__GPC
augggccagaucgucaccuucuuccaggaggucccccacgucaucgaggaggucaugaacaucguccucaucgcccucuccauccucgccguccucaagggccucuacaacuucgccaccugcggccucgucggccuccucaccuuccuccuccucugcggccgcuccugcaccaccggccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccgaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucgucaugaagaaccaccuccgcgacaucaugggcauccccuacugcaacuacucccgcuacugguaccucaaccacaccaccaccggccgcaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1149 - RNA, 1476 nt, Artificial Sequence
  derived and/or modified CDS sequence (opt2) from Lassa virus__AIT17130__GPC
augggccagaucgucaccuucuuccaggaggucccccacgucaucgaggaggucaugaacaucguccucaucgcccucuccauccucgccguccucaagggccucuacaacuucgccaccugcggcuucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacauccgcgucggcaacgacaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccucccacugcggcaccaucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1150 - RNA, 1476 nt, Artificial Sequence
  derived and/or modified CDS sequence (opt2) from Lassa virus__AIT17134__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1151 - RNA, 1476 nt, Artificial Sequence
  derived and/or modified CDS sequence (opt2) from Lassa virus__AIT17138__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccucccucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccucccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1152 - RNA, 1476 nt, Artificial Sequence
  derived and/or modified CDS sequence (opt2) from Lassa virus__AIT17142__GPC
augggccagaucgucaccuucuuccaggaggucccccacgucaucgaggaggucaugaacaucguccucaucgcccucuccguccucgccguccucaagggccucuacaacuucgccaccugcggcaucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgacaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccgaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1153 - RNA, 1476 nt, Artificial Sequence
  derived and/or modified CDS sequence (opt2) from Lassa virus__AIT17146__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugcuccuucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggcuucuacaagcagcccggcguccccgucaaguggaagcgcuga

SEQ ID NO: 1154 - RNA, 1476 nt, Artificial Sequence
  derived and/or modified CDS sequence (opt2) from Lassa virus__AIT17154__GPC
augggccagaucgucaccuucuuccaggaggucccccacgucaucgaggaggucaugaacaucguccucaucgcccucuccauccucgccguccucaagggccucuacaacuucgccaccugcggcaucgucggccucgucuccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccaucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacgucgucggcaaguccugccccaagccccaccgccucaaccacaugggcaucugcuccugcggccucuacggccagcccggcguccccgucaaguggaagcgcuga

SEQ ID NO: 1155 - RNA, 1476 nt, Artificial Sequence
  derived and/or modified CDS sequence (opt2) from Lassa virus__AIT17158__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1156 - RNA, 1476 nt, Artificial Sequence
  derived and/or modified CDS sequence (opt2) from Lassa virus__AIT17164__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccuccucccucuacaagggcgucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaagcacugcggcaccgucgccaacggcguccuccagaccuucaugcgcauggccuggggcggcuccuacaucgcccucgacuccggccacggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacgcccccggcggcuacugccucacccgcuggaugcucauccaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuucaagcagcccggcguccccgucaaguggaagcgcuga

SEQ ID NO: 1157 - RNA, 1476 nt, Artificial Sequence
  derived and/or modified CDS sequence (opt2) from Lassa virus__AIT17168__GPC
augggccagaucgucaccuucuuccaggaggucccccacgucaucgaggaggucaugaacaucguccucaucgcccucuccauccucgccguccucaagggccucuacaacuucgccaccugcggccucgucggccuccucaccuuccuccuccucugcggccgcuccugcaccgccucccgcuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1158 - RNA, 1476 nt, Artificial Sequence
  derived and/or modified CDS sequence (opt2) from Lassa virus__AIT17172__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugcccccgcccccaccgccucaaccacaugggcaucugcuccugcggccucuacaagcagcccggcguccccgucaaguggaagcgcuga

SEQ ID NO: 1159 - RNA, 1476 nt, Artificial Sequence
  derived and/or modified CDS sequence (opt2) from Lassa virus__AIT17176__GPC
augggccagaucgucaccuucuuccaggaggucccccacgucaucgaggaggucaugaacaucguccucaucgcccucucccuccucgccguccucaagggccucuacaacgucgccaccugcggccucaucggccucaucaccuuccuccuccucugcggccgcuccugcaccaccaaccucuacaagggcgucuacgagcuccaggcccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggccgcaucuccguccaguacaaccucucccacuccuacgccggcgacgccgccucccacugcggcaccaucgccaacggcguccuccagaccuucaugcgcauggccuggggcggcuccuacaucgcccucgacuccggccacggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggccucuacaagcagcccggcguccccguccgcuggaagcgcuga

SEQ ID NO: 1160 - RNA, 1476 nt, Artificial Sequence
  derived and/or modified CDS sequence (opt2) from Lassa virus__AIT17180__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccuccuccucugcggccgcuccugcaccaccacccucuacaagggcgucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggacgaccacugccaguucucccgccccucccccaucggcuaccucggccuccucucccagcgcacccgcgacgucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaacaacaccgccaccggcaagaccucccuccccaagugcuggcucaucuccaacggcuccuaccucaacgagacccacuucuccgacgacaucgagcaggaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccguccgcuggaagcgcuga

SEQ ID NO: 1161 - RNA, 1476 nt, Artificial Sequence
  derived and/or modified CDS sequence (opt2) from Lassa virus__AIT17184__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccuccuccucugcggccgcuccugcaccaccacccucuacaagggcgucuacgagcuccaggcccucgagcucaacauggagacccucaacaugaccaugccccucuccugcaccaagaacaacucccaccacuacauccgcgucggcaacgagaccggccucgagcucacccucaccaacaccuccaucaucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcaacggcugggacugcaucaugaccuccuaccaguaccucaucauccagaacaccaccugggacgaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaacaacaccgccaccggcaagaccucccucccccgcugcuggcucgucuccaacggcuccuaccucaacgagacccacuucuccgacgacaucgagcagcaggccgacaacaugaucaccgagaugcuccagcgcgaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1162 - RNA, 1476 nt, Artificial Sequence
  derived and/or modified CDS sequence (opt2) from Lassa virus__AIT17188__GPC
augggccagaucgucaccuucuuccaggaggucccccacgucaucgaggaggucaugaacaucguccucaucgcccucuccauccucgccguccucaagggccucuacaacuucgccaccugcggcuucgucggccucgucuccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccacggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccuccgcgccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacggccagcccggcguccccgucaaguggaagcgcuga

SEQ ID NO: 1163 - RNA, 1476 nt, Artificial Sequence
  derived and/or modified CDS sequence (opt2) from Lassa virus__AIT17192__GPC
augggccagaucgucaccuucuuccaggaggucccccacgucaucgaggaggucaugaacaucguccucaucgcccucuccauccucgccguccucaagggccucuacaacuucgccaccugcggcuucaucggccucgucuccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguucgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccacggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacggccagcccggcguccccgucaaguggaagcgcuga

SEQ ID NO: 1164 - RNA, 1476 nt, Artificial Sequence
  derived and/or modified CDS sequence (opt2) from Lassa virus__AIT17196__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagaugaacauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggcuucuacaagcagcccggcguccccgucaaguggaagcgcuga

SEQ ID NO: 1165 - RNA, 1476 nt, Artificial Sequence
  derived and/or modified CDS sequence (opt2) from Lassa virus__AIT17204__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccuccucccucuacaagggcgucuacgagcuccagacccucgagcucaacauggagacccucaacaugaccaugccccucuccugcaccaagaacuccucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccuccccaagugcuggcucgucuccaacggcuccuaccucaacaagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucaucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1166 - RNA, 1476 nt, Artificial Sequence
  derived and/or modified CDS sequence (opt2) from Lassa virus__AIT17208__GPC
augggccagaucgucaccuucuuccaggaggucccccacgucaucgaggaggucaugaacaucguccucaucgcccucuccauccucgccguccucaagggccucuacaacuucgccaccugcggccucaucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggccagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1167 - RNA, 1476 nt, Artificial Sequence
  derived and/or modified CDS sequence (opt2) from Lassa virus__AIT17210__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccgccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1168 - RNA, 1476 nt, Artificial Sequence
  derived and/or modified CDS sequence (opt2) from Lassa virus__AIT17212__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccaccgcaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1169 - RNA, 1476 nt, Artificial Sequence
  derived and/or modified CDS sequence (opt2) from Lassa virus__AIT17216__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaacuacaugggcaucugcuccugcggccucuacaagcagcccggcguccccguccgcuggaagcgcuga

SEQ ID NO: 1170 - RNA, 1476 nt, Artificial Sequence
  derived and/or modified CDS sequence (opt2) from Lassa virus__AIT17224__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccuccuccucugcggccgcuccugcaccaccacccucuacaagggcgucuacgagcuccaggcccucgagcucaacauggagacccucaacaugaccaugccccucuccugcaccaagaacaacucccaccacuacauccgcgucggcaacgacaccggccucgagcucacccucaccaacaccuccaucauccagcacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacuccuacgccggcgacgccgccucccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggccgcgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaacaacaccaucaccggcaaguccucccuccccaagugcuggcucgucuccaacggcuccuaccucaacgagacccacuucuccgacgacaucgagcaggaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcgucugcuccugcggccucuacaagcagcccggcguccccguccgcuggaagcgcuga

SEQ ID NO: 1171 - RNA, 1476 nt, Artificial Sequence
  derived and/or modified CDS sequence (opt2) from Lassa virus__AIT17228__GPC
augggccagaucgucaccuucuuccaggaggucccccacgucaucgaggaggucaugaacaucguccucaucgcccucuccauccucgccguccucaagggccucuacaacuucgccaccugcggccucgucggccuccucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1172 - RNA, 1476 nt, Artificial Sequence
  derived and/or modified CDS sequence (opt2) from Lassa virus__AIT17232__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacgagggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucgagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1173 - RNA, 1476 nt, Artificial Sequence
  derived and/or modified CDS sequence (opt2) from Lassa virus__AIT17236__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggccgcaucuccguccaguacaaccucucccacuccuacgccggcgaggccgccaaccacugcggcaccgucgccaacggcguccuccagaccuucaugcgcauggccuggggcggcuccuacaucgcccucgacuccggccgcggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacucccgcuacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1174 - RNA, 1476 nt, Artificial Sequence
  derived and/or modified CDS sequence (opt2) from Lassa virus__AIT17240__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcuucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagaagacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1175 - RNA, 1476 nt, Artificial Sequence
  derived and/or modified CDS sequence (opt2) from Lassa virus__AIT17244__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccaaccucuacaagggcgucuacgagcuccagacccucgagcucaacauggagacccucaacaugaccaugccccucuccugcaccaagaacuccucccaccacuacauccgcgucggcaacgagaccggccucgagcucacccucaccaacaccuccaucaucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgucggcgacgccgccgaccacugcggcaccgucgccaacggcguccuccagaccuucaugcgcauggccuggggcggcuccuacaucgcccucgacuccggccgcggcaagugggacugcaucaucaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccucccccgcugcuggcucgucuccaacggcuccuaccucaacgagacccgcuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1176 - RNA, 1476 nt, Artificial Sequence
  derived and/or modified CDS sequence (opt2) from Lassa virus__AIT17246__GPC
augggccagaucgucaccuucuuccaggaggucccccacgucaucgaggaggucaugaacaucguccucaucgcccucucccuccucgccguccucaagggccucuacaacgucgccaccugcggccucaucggccucaucaccuuccuccuccucugcggccgcuccugcaccaccaaccucuacaagggcgucuacgagcuccagacccucgagcucaacauggagacccucaacaugaccaugccccucuccugcaccaagaacuccucccaccacuacaucauggucggcaacgagaccggccucgagcucacccucaccaacaccuccaucaucaaccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcauccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1177 - RNA, 1476 nt, Artificial Sequence
  derived and/or modified CDS sequence (opt2) from Lassa virus__AIT17250__GPC
augggccagaucgucaccuucuuccaggaggucccccacgucaucgaggaggucaugaacaucguccucaucgcccucucccuccucgccguccucaagggccucuacaacgucgccaccugcggccucaucggccucgucaccuuccuccuccucugcggccgcuccugcaccaccaaccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1178 - RNA, 1476 nt, Artificial Sequence
  derived and/or modified CDS sequence (opt2) from Lassa virus__AIT17254__GPC
augggccagaucgucaccuucuuccaggaggucccccacgucaucgaggaggucaugaacaucguccucaucgcccucuccauccucgccguccucaagggccucuacaacuucgccaccugcggcaucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaagaacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccaucucccucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccucccccgcugcuggcucgucuccaacggcuccuaccucaacgagacccacuucuccgacgacaucgagcagcaggccgacaacaugaucaccgagaugcuccagaaggaguacauggaccgccagggcaagaccccccucggccucgucgaccucuucgucuucuccaccuccuucuaccucaucuccaucuuccuccaccucgucaagauccccacccaccgccacaucgucggcaagaccugccccaagccccaccgccucaaccacaugggcaucugcuccugcggccucuacaagcagcccggcguccccgucaaguggaagcgcuga

SEQ ID NO: 1179 - RNA, 1476 nt, Artificial Sequence
  derived and/or modified CDS sequence (opt2) from Lassa virus__AIT17258__GPC
augggccagaucgucaccuucuuccaggaggucccccacgucaucgaggaggucaugaacaucguccucaucgcccucuccauccucgccguccucaagggccucuacaacaucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucgucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacgucaccugggaggaccacugccaguucucccgccccucccccaucggcuaccucggccuccucucccagcgcacccgcgacgucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1180 - RNA, 1476 nt, Artificial Sequence
  derived and/or modified CDS sequence (opt2) from Lassa virus__AIT17262__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccacccacugcggcaccgucgccaacggcguccuccagaccuucaugcgcauggccuggggcggcuccuacaucgcccucgacuccggccgcggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1181 - RNA, 1476 nt, Artificial Sequence
  derived and/or modified CDS sequence (opt2) from Lassa virus__AIT17266__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccucccucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1182 - RNA, 1476 nt, Artificial Sequence
  derived and/or modified CDS sequence (opt2) from Lassa virus__AIT17270__GPC
augggccagaucgucaccuucuuccaggaggucccccacgucaucgaggaggucaugaacaucguccucaucgcccucuccguccucgccguccucaagggccucuacaacuucgccaccugcggccucgucggccucgucaccuuccuccuccucugcggccgcuccugcuccaccuccgucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccacggcggcugggacugcaucaugaccaacuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccuccccaagugcuggcucgucuccaacggcuccuaccucaacgagacccacuucuccgacgacaucgagcagcaggccgacaacaugaucaccgagaugcuccagcgcgaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1183 - RNA, 1476 nt, Artificial Sequence
  derived and/or modified CDS sequence (opt2) from Lassa virus__AIT17274__GPC
augggccagaucgucaccuucuuccaggaggucccccacgucaucgaggaggucaugaacaucguccucaucgcccucuccauccucgccguccucaagggccucuacaacgucgccaccugcggccucaccggccucgucgccuuccuccuccucugcggccgcuccugcaccaccacccucuacaagggcgucuacgagcuccaggcccucgagcucaacauggagacccucaacaugaccaugccccucuccugcaccaagaacaacucccaccacuacauccgcgucggcaacgagaccggccucgagcucacccucaccaacaccuccaucaucgagcaccgcuucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcaacggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaacaacaccgccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcgcccccguccgcuggaagcgcuga

SEQ ID NO: 1184 - RNA, 1476 nt, Artificial Sequence
  derived and/or modified CDS sequence (opt2) from Lassa virus__AIT17276__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccguccgcuggaagcgcuga

SEQ ID NO: 1185 - RNA, 1473 nt, Artificial Sequence
  derived and/or modified CDS sequence (opt2) from Lassa virus__AIT17280__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacgagugggacugcaucaugaccuccuaccaguaccucaucauccagaacaccaccugggacaaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggucgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggcuucuacaagcagcccggcguccccgucaaguggaagcgcuga

SEQ ID NO: 1186 - RNA, 1476 nt, Artificial Sequence
  derived and/or modified CDS sequence (opt2) from Lassa virus__AIT17288__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcggcuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccguccgcuggaagcgcuga

SEQ ID NO: 1187 - RNA, 1476 nt, Artificial Sequence
  derived and/or modified CDS sequence (opt2) from Lassa virus__AIT17292__GPC
augggccagaucgucaccuucuuccaggaggucccccacgucaucgaggaggucaugaacaucguccucaucgcccucuccaucauggccguccucaagggccucuacaacaucgccaccugcggccucgucggccucgucaccuuccuccuccucugcggccgcuccugcaccaccacccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacggcggcugggacugcaucaugaccuccuaccaguaccucaucauccagaacaccaccugggaggaccacugccaguucacccgccccucccccaucggcuaccucggccuccucucccagcgcacccgcgacaucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccuccgcgccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucaucaagauccccacccaccgccacaucgucggcaagcccugccccaagccccaccgccucaaccacaugggcgucugcuccugcggccucuacaagcagcccggcguccccguccgcuggaagcgcuga

SEQ ID NO: 1188 - RNA, 1476 nt, Artificial Sequence
  derived and/or modified CDS sequence (opt2) from Lassa virus__AIT17294__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggaggaccacugccaguucucccgccccucccccgucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1189 - RNA, 1476 nt, Artificial Sequence
  derived and/or modified CDS sequence (opt2) from Lassa virus__AIT17298__GPC
augggccagaucgucaccuucuuccaggaggucccccacgucaucgaggaggucaugaacaucguccucaucgcccucuccauccucgccguccucaagggccucuacaacaucgccaccugcggccuccucggccucgucugcuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccucccacugcggcaccaucgccaacggcguccuccagaccuucaugcgcauggccuggggcggcuccuacaucgcccucgacuccggccacggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggccucuacggccagcccggcguccccgucaaguggaagcgcuga

SEQ ID NO: 1190 - RNA, 1476 nt, Artificial Sequence
  derived and/or modified CDS sequence (opt2) from Lassa virus__AIT17302__GPC
augggccagaucgucaccuucuuccaggaggucccccacgucaucgaggaggucaugaacaucguccucaucgcccucucccuccucgccguccucaagggccucuacaacgucgccaccugcggccucaucggccucgucaccuuccuccuccucugcggccgcuccugcaccaccaaccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucucccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1191 - RNA, 1476 nt, Artificial Sequence
  derived and/or modified CDS sequence (opt2) from Lassa virus__AIT17310__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccacccacugcggcaccgucgccaacggcguccuccagaccuucaugcgcauggccuggggcggcuccuacaucgcccucgacuccggccgcggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaacuacaugggcaucugcuccugcggccucuacaagcagcccggcguccccgucaaguggaagcgcuga

SEQ ID NO: 1192 - RNA, 1476 nt, Artificial Sequence
  derived and/or modified CDS sequence (opt2) from Lassa virus__AIT17314__GPC
augggccagaucgucaccuucuuccaggaggucccccacgucaucgaggaggucaugaacaucguccucaucacccucuccauccucgccguccucaagggccucuacaacgucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaaggaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1193 - RNA, 1476 nt, Artificial Sequence
  derived and/or modified CDS sequence (opt2) from Lassa virus__AIT17318__GPC
augggccagaucgucaccuucuuccaggaggucccccacgucaucgaggaggucaugaacaucguccucaucgcccucucccuccucgccguccucaagggccucuacaacgucgccaccugcggccucaucggccucgucaccuuccuccuccucugcggccgcuccugcaccaccaaccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaucaccugggaggaccacugccaguucucccgccccucccccaucggcuaccucggccuccucucccagcgcacccgcgacaucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1194 - RNA, 1476 nt, Artificial Sequence
  derived and/or modified CDS sequence (opt2) from Lassa virus__AIT17322__GPC
augggccagaucgucaccuucuuccaggaggucccccacgucaucgaggaggucaugaacaucguccucaucgcccucucccuccucgccguccucaagggccucuacaacgucgccaccugcggccucaucggccucgucaccuuccuccuccucugcggccgcuccugcaccaccaaccucuacaagggcgccuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1195 - RNA, 1476 nt, Artificial Sequence
  derived and/or modified CDS sequence (opt2) from Lassa virus__AIT17328__GPC
augggccagaucgucaccuucuuccaggaggucccccacgucaucgaggaggucaugaacaucguccucaucacccucuccauccucgccguccucaagggccucuacaacaucgccaccugcggccucgucggccucgucaccuuccuccuccucugcggcaaguccugcaccaccucccucuacaagggcgucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccacggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacgcccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacgucgucggcaaguccugccccaagccccaccgccucaaccacaugggcaucugcuccugcggccucuacaagcagcccggcguccccgucaaguggaagcgcuga

SEQ ID NO: 1196 - RNA, 1476 nt, Artificial Sequence
  derived and/or modified CDS sequence (opt2) from Lassa virus__AIT17332__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccacggccgcugggacugcaucaugaccuccuaccaguaccucaucauccagaacaccaccugggaggaccacugccucuucucccgccccucccccaucggcuaccucggccuccucucccagcgcacccgcgacaucuacaucucccgccgccuccucggcaccuucaccuggacccucuccgacuccgagggccgcgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1197 - RNA, 1476 nt, Artificial Sequence
  derived and/or modified CDS sequence (opt2) from Lassa virus__AIT17340__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaucuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcgagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugcccccgcccccaccgccucaaccacaugggcaucugcuccugcggccucuacaagcagcccggcguccccgucaaguggaagcgcuga

SEQ ID NO: 1198 - RNA, 1476 nt, Artificial Sequence
  derived and/or modified CDS sequence (opt2) from Lassa virus__AIT17344__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacaaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccucccacugcggcaccgucgccaacggcguccuccagaccuucaugcgcauggccuggggcggcuccuacaucgcccucgacuccggcuacggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccguccgcuggaagcgcuga

SEQ ID NO: 1199 - RNA, 1476 nt, Artificial Sequence
  derived and/or modified CDS sequence (opt2) from Lassa virus__AIT17348__GPC
augggccagaucgucaccuucuuccaggaggucccccacgucaucgaggaggucaugaacaucguccucaucgcccucuccauccucgccguccucaagggccucuacaacaucgccaccugcggccucaucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1200 - RNA, 1476 nt, Artificial Sequence
  derived and/or modified CDS sequence (opt2) from Lassa virus__AIT17350__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccuccuccucugcggccgcuccugcaccaccacccucuacaagggcgucuacgagcuccaggcccucgagcucaacauggagacccucaacaugaccaugccccucuccugcaccaagaacaacucccaccacuacaucauggucggcaacgagaccggccucgagcucacccucaccaacaccuccaucaucgaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaagcacugcggcaccgucgccaacggcguccuccagaccuucaugcgcauggccuggggcggcuccuacaucgcccucgacuccggccgcaacggcugggacugcgucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagaugcuccagaaggaguacaucgagcgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcagcccggcguccccguccgcuggaagcgcuga

SEQ ID NO: 1201 - RNA, 1476 nt, Artificial Sequence
  derived and/or modified CDS sequence (opt2) from Lassa virus__AIT17354__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaucuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugcccccgcccccaccgccucaaccacaugggcaucugcuccugcggccucuacaagcagcccggcguccccgucaaguggaagcgcuga

SEQ ID NO: 1202 - RNA, 1476 nt, Artificial Sequence
  derived and/or modified CDS sequence (opt2) from Lassa virus__AIT17360__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacauccgcgucggcaacgagaccggccucgagcucacccucaccaacaccuccaucaucaaccaccgcuucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacggcaagugggacugcaucaugaccuccuaccaguaccucaucauccagaacaccaccugggacgaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggcuucuacaagcagcccggcguccccgucaaguggaagcgcuga

SEQ ID NO: 1203 - RNA, 1476 nt, Artificial Sequence
  derived and/or modified CDS sequence (opt2) from Lassa virus__AIT17364__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacaucgagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcgucuccgucaaguggaagcgcuga

SEQ ID NO: 1204 - RNA, 1476 nt, Artificial Sequence
  derived and/or modified CDS sequence (opt2) from Lassa virus__AIT17368__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguucgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacuccaagugggacugcaucaugaccuccuaccaguaccucaucauccagaacaccaccugggacgaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaacuacaugggcaucugcuccugcggcuucuacaagcagcccggcguccccgucaaguggaagcgcuga

SEQ ID NO: 1205 - RNA, 1476 nt, Artificial Sequence
  derived and/or modified CDS sequence (opt2) from Lassa virus__AIT17370__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcgucuccgucaaguggaagcgcuga

SEQ ID NO: 1206 - RNA, 1476 nt, Artificial Sequence
  derived and/or modified CDS sequence (opt2) from Lassa virus__AIT17378__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacacccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcuccggcugggacugcaucaugaccuccuaccaguaccucgucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaagaacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggccgcaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggcuucuacaagcagcccggcguccccgucaaguggaagcgcuga

SEQ ID NO: 1207 - RNA, 1476 nt, Artificial Sequence
  derived and/or modified CDS sequence (opt2) from Lassa virus__AIT17388__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccuccuccucugcggccgcuccugcaccaccacccucuacaagggcgucuacgagcuccaggcccucgagcucaacauggagacccucaacaugaccaugccccucuccugcaccaagaacaacucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaucaucuccguccaguacaaccucucccacuccuacgccggcgacgccgccaaccacugcggcaccgucgccaacggcguccuccagaccuucaugcgcauggccuggggcggcuccuacaucgcccucgacuccggccgcaacggcugggacugcaucaugaccuccuaccaguaccucaucauccagaacaccaccugggacgaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagaugaacauccagcucaucaacaaggccgucaacgcccucaucaacgaccagcucaucaugaagaaccaccuccgcgacaucaugggcauccccuacugcaacuacuccaaguacugguaccucaacaacaccgccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaucggcaucugcuccugcggccucuacaagcagcccggcguccccgucaaguggaagcgcuga

SEQ ID NO: 1208 - RNA, 1473 nt, Artificial Sequence
  derived and/or modified CDS sequence (opt2) from Lassa virus__AIT17404__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucaucaagauccccacccaccgccacaucaccggcaagcccugccccaagccccaccgccucaaccacaugggcaucugcuccugcggccucuacaagcaccccggcguccccgucaaguggaagcgcuga

SEQ ID NO: 1209 - RNA, 1473 nt, Artificial Sequence
  derived and/or modified CDS sequence (opt2) from Lassa virus__AIT17408__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccgucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1210 - RNA, 1473 nt, Artificial Sequence
  derived and/or modified CDS sequence (opt2) from Lassa virus__AIT17412__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccuccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1211 - RNA, 1473 nt, Artificial Sequence
  derived and/or modified CDS sequence (opt2) from Lassa virus__AIT17416__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccaccgcaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccuccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1212 - RNA, 1473 nt, Artificial Sequence
  derived and/or modified CDS sequence (opt2) from Lassa virus__AIT17420__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucaucaagauccccacccaccgccacaucaccggcaagcccugccccaagccccaccgccucaaccacaugggcaucugcuccugcggccucuacaagcaccccggcguccccgucaaguggaagcgcuga

SEQ ID NO: 1213 - RNA, 1473 nt, Artificial Sequence
  derived and/or modified CDS sequence (opt2) from Lassa virus__AIT17424__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacaugaccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacaaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagaccaacauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1214 - RNA, 1473 nt, Artificial Sequence
  derived and/or modified CDS sequence (opt2) from Lassa virus__AIT17428__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgccgccgaccucaagugcuucggcaacaccgccgucgccaagugcaacgagaagcacgacgaggaguucugcgacaugcuccgccucuucgacuucaacaagcaggccaucgagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucguccgcauccccacccaccgccacgucaucggcaagcccugccccaagccccaccgccucaaccacaugggcaucugcuccugcggccucuacaagcaccccggcguccccgucaaguggaagcgcuga

SEQ ID NO: 1215 - RNA, 1473 nt, Artificial Sequence
  derived and/or modified CDS sequence (opt2) from Lassa virus__AIT17430__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggccgcaucuccguccaguacaaccucucccacaccuacgccgucgacgccgccaagcacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1216 - RNA, 1473 nt, Artificial Sequence
  derived and/or modified CDS sequence (opt2) from Lassa virus__AIT17438__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccaaccucaacaugaccaugccccucuccugcaccaagaacaacucccaccacuacauccgcgucggcaacgagaccggccucgagcucacccucaccaacaccuccaucaucucccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagaugaacauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccagaugggcaucugcuccugcggccucuacaagcagcccggcguccccgucaaguggaagcgcuga

SEQ ID NO: 1217 - RNA, 1473 nt, Artificial Sequence
  derived and/or modified CDS sequence (opt2) from Lassa virus__AIT17442__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccaccgcaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccuccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgcaucaaccacaugggcaucugcuccugcggccucuacaagcaccccggcguccccgucaaguggaagcgcuga

SEQ ID NO: 1218 - RNA, 1473 nt, Artificial Sequence
  derived and/or modified CDS sequence (opt2) from Lassa virus__AIT17446__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccucccacugcggcaccgucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1219 - RNA, 1473 nt, Artificial Sequence
  derived and/or modified CDS sequence (opt2) from Lassa virus__AIT17450__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1220 - RNA, 1473 nt, Artificial Sequence
  derived and/or modified CDS sequence (opt2) from Lassa virus__AIT17454__GPC
augggccagaucaucaccuucuuccaggaggucccccacgucaucgaggaggucaugaacaucguccucaucgccuucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagcgcaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccggccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccguccgcuggaagcgcuga

SEQ ID NO: 1221 - RNA, 1473 nt, Artificial Sequence
  derived and/or modified CDS sequence (opt2) from Lassa virus__AIT17458__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccaucgacgccgccaaccacugcggcaccaucgccaacggcguccuccagaccuucaugcgcauggccuggggcggcuccuacaucgcccucgacuccggcaagggcuccugggacugcaucaugaccaccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1222 - RNA, 1473 nt, Artificial Sequence
  derived and/or modified CDS sequence (opt2) from Lassa virus__AIT17462__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1223 - RNA, 1473 nt, Artificial Sequence
  derived and/or modified CDS sequence (opt2) from Lassa virus__AIT17466__GPC
augggccagaucaucaccuucuuccaggaggucccccaggucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaaccaguccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuucgccgucgacgccgccaaccacugcggcaccaucgccaacggcguccuccagaccuucaugcgcauggccuggggcggcuccuacaucgcccucgacuccggccgcggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1224 - RNA, 1473 nt, Artificial Sequence
  derived and/or modified CDS sequence (opt2) from Lassa virus__AIT17470__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccaccgcaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1225 - RNA, 1473 nt, Artificial Sequence
  derived and/or modified CDS sequence (opt2) from Lassa virus__AIT17474__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccauccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaccggcaagcccugccccaagccccaccgccucaaccacaugggcaucugcuccugcggccucuacaagcaccccggcguccccguccgcuggaagcgcuga

SEQ ID NO: 1226 - RNA, 1473 nt, Artificial Sequence
  derived and/or modified CDS sequence (opt2) from Lassa virus__AIT17478__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccgaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucucccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1227 - RNA, 1473 nt, Artificial Sequence
  derived and/or modified CDS sequence (opt2) from Lassa virus__AIT17482__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaucaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggccucuacaagcaccccggcguccccgucaaguggaagcgcuga

SEQ ID NO: 1228 - RNA, 1473 nt, Artificial Sequence
  derived and/or modified CDS sequence (opt2) from Lassa virus__AIT17486__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccgucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1229 - RNA, 1473 nt, Artificial Sequence
  derived and/or modified CDS sequence (opt2) from Lassa virus__AIT17490__GPC
augggccagaucaucaccuucuuccaggaggucccccacgucaucgaggaggucaugaacaucguccucaucacccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuucgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1230 - RNA, 1473 nt, Artificial Sequence
  derived and/or modified CDS sequence (opt2) from Lassa virus__AIT17494__GPC
augggccagaucaucaccuucuuccaggaggucccccacgucaucgaggaggucaugaacaucguccucaucgcccucucccuccucgccauccucaagggcgucuacaacgucgccaccugcggccucuucggccucgucuccuuccuccuccucugcggccgcuccugcuccaccaucuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccuccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1231 - RNA, 1473 nt, Artificial Sequence
  derived and/or modified CDS sequence (opt2) from Lassa virus__AIT17498__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgagaccgagcucaagugcuucggcaacaccgccgucgccaagugcaacgagaagcacgacgaggaguucugcgacaugcuccgccucuucgacuucaacaagcaggccaucucccgccuccgcuccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucgucaagauccccacccaccgccacaucaccggcaagcccugccccaagccccaccgccucaaccacaugggcaucugcuccugcggccucuacaagcaccccggcguccccgucaaguggaagcgcuga

SEQ ID NO: 1232 - RNA, 1473 nt, Artificial Sequence
  derived and/or modified CDS sequence (opt2) from Lassa virus__AIT17502__GPC
augggccagaucaucaccuucuuccaggagaucccccacgucaucgaggaggucaugaacaucguccucaucacccucucccuccucgccauccucaagggcaucuacaacgucgccaccugcggccucuucggccucgucuccuuccuccuccucugcggcaaguccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccaccgcaagaaccucuacgaccacacccucauguccaucaucuccaccuuccaccucuccauccccaacuucaaccaguacgaggccauguccugcgacuucaacggcggcaagaucuccguccaguacaaccucucccacgccuacgccaucgacgccgccacccacugcggcaccaucgccaacggcguccuccagaccuucaugcgcauggccuggggcggcuccuacaucgcccucgacuccggcaagggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugcgcaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcgucugcuccugcggccucuacaagcaccccggcguccccgucaaguggaagcgcuga

SEQ ID NO: 1233 - RNA, 1473 nt, Artificial Sequence
  derived and/or modified CDS sequence (opt2) from Lassa virus__AIT17506__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccgagcacugcggcaccaucgccaacggcguccuccagaccuucaugcgcauggccuggggcggcuccuacaucgcccucgacuccggcaagggcuccugggacugcgucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucgagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1234 - RNA, 1473 nt, Artificial Sequence
  derived and/or modified CDS sequence (opt2) from Lassa virus__AIT17510__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcaccaaggacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1235 - RNA, 1473 nt, Artificial Sequence
  derived and/or modified CDS sequence (opt2) from Lassa virus__AIT17514__GPC
augggccagaucaucaccuucuuccaggaggucccccacgucaucgaggaggucaugaacaucguccucaucgcccucucccuccucgccguccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuaccgccaccccggcguccccgucaaguggaagcgcuga

SEQ ID NO: 1236 - RNA, 1473 nt, Artificial Sequence
  derived and/or modified CDS sequence (opt2) from Lassa virus__AIT17518__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1237 - RNA, 1473 nt, Artificial Sequence
  derived and/or modified CDS sequence (opt2) from Lassa virus__AIT17524__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccaucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagaugcuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1238 - RNA, 1473 nt, Artificial Sequence
  derived and/or modified CDS sequence (opt2) from Lassa virus__AIT17528__GPC
augggccagaucaucaccuucuuccaggaggucccccacgucaucgaggaggucaugaacaucguccucaucgcccucucccuccucgccaugcucaagggcaucuacaacaucgccaccugcggccucuucggccucaucuccuuccuccuccucugcggccgcuccugcuccaccaccuacaagggcgucuacgagcuccaggcccucgagcucgacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccggcgacgccgccaagcacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacuccgucaccggccgcaccucccucccccgcugcuggcucgucuccaacggcuccuaccucaacgagacccaguucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucaucaagauccccacccaccgccacaucgucggcaagcccugccccaagccccaccgccucaaccacaugggcaucugcuccugcggccucuacaagcaccccggcauccccgucaaguggaagcgcuga

SEQ ID NO: 1239 - RNA, 1473 nt, Artificial Sequence
  derived and/or modified CDS sequence (opt2) from Lassa virus__AIT17538__GPC
augggccagaucaucaccuucuuccaggaggucccccacgucaucgaggaggucaugaacaucguccucaucgcccucucccuccucgccauccucaagggcaucuacaacaucgccaccugcggccucuucggccucaucuccuuccuccuccucugcggccgcuccugcuccaccaccuacaagggcgucuacgagcuccagacccucgagcucgacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacgagggcaagaucuccguccaguacaaccucucccacuccuacgccaucgacgccgccggccacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgaggcccccggcggcuacugccucacccgcuggaugcucaucgaggccgagcucaagugcuucggcaacaccgccaucgccaagugcaacgagaagcacgacgaggaguucugcgacaugcuccgccucuucgacuucaacaagcaggccaucaagcgccucaaggccgaggcccagauguccauccaccucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucgucggccgccccugccccaagccccaccgccucaaccacaugggcaucugcuccugcggccucuacaagcaccccggcguccccgucaaguggaagcgcuga

SEQ ID NO: 1240 - RNA, 1473 nt, Artificial Sequence
  derived and/or modified CDS sequence (opt2) from Lassa virus__AIT17540__GPC
augggccagaucgucaccuucuuccaggaggucccccacgucaucgaggagaucaugaacaucguccucaucacccucucccuccucgccauccucaagggcaucuacaacuucgccaccugcggccucaucggccucaucaccuuccucuuccucugcggccgcuccugcuccaccaucuacaagggcuccuaccagcuccagacccucgagcucaacauggagacccucaacaugaccaugccccucuccugcaccaagaacaacucccaccacuacauccgcgucggcaacgagaccggccucgagcucacccucaccaacaccuccaucaucaaccacaaguucugcaaccucuccgaggcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccuccaccggccgcaccucccuccccaagugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1241 - RNA, 1473 nt, Artificial Sequence
  derived and/or modified CDS sequence (opt2) from Lassa virus__AIT17544__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacaugggcucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1242 - RNA, 1473 nt, Artificial Sequence
  derived and/or modified CDS sequence (opt2) from Lassa virus__AIT17548__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccucuuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagcgcaaccucuacgaccacgcccucauguccaucaucuccaccuuccaccucuccauccccaacuucaaccaguacgaggccauguccugcgacuucaacggcggcaagaucuccguccaguacaaccucucccacgccuacgccggcgacgccgccaagcacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccuccgcaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1243 - RNA, 1473 nt, Artificial Sequence
  derived and/or modified CDS sequence (opt2) from Lassa virus__AIT17552__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucaacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagaaguga

SEQ ID NO: 1244 - RNA, 1473 nt, Artificial Sequence
  derived and/or modified CDS sequence (opt2) from Lassa virus__AIT17556__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggccgcggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaccggcaagcccugccccaagccccaccgccucaaccacaugggcaucugcuccugcggccucuacaagcaccccggcguccccguccgcuggaagcgcuga

SEQ ID NO: 1245 - RNA, 1473 nt, Artificial Sequence
  derived and/or modified CDS sequence (opt2) from Lassa virus__AIT17560__GPC
augggccagaucaucaccuucuuccaggaggucccccacgucaucgaggaggucaugaacaucguccucaucgcccucucccuccucgccguccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaccaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccggcgaggccgccaaccacugcggcaccaucgccaacggcguccuccagaccuucaugcgcauggccuggggcggcuccuacaucgcccucgacuccggcaagggcuccugggacugcaucaugaccuccuacaaguaccucaucauccagaacaccaccuggggcgaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgcaagcucaagaccgaggcccagauguccauccagcucaucaacaaggccgucaacgcccucaucaacgaccagcucaucaugaagaaccaccuccgcgacaucaugggcauccccuacugcaacuacucccgcuacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1246 - RNA, 1473 nt, Artificial Sequence
  derived and/or modified CDS sequence (opt2) from Lassa virus__AIT17564__GPC
augggccagaucaucaccuucuuccaggaggucccccacgucaucgaggaggucaugaacaucguccucaucgcccucucccuccucgccauccucaagggcaucuacaacgucgccaccugcggccucuucggccuccucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaaggaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaagcacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccuccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucaagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1247 - RNA, 1473 nt, Artificial Sequence
  derived and/or modified CDS sequence (opt2) from Lassa virus__AIT17572__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaacuacgccgucgacgccgccaaccacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgacaugcccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagaugaacauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1248 - RNA, 1473 nt, Artificial Sequence
  derived and/or modified CDS sequence (opt2) from Lassa virus__AIT17576__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucucccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucgucaagauccccacccaccgccacaucaccggcaagcccugccccaagccccaccgccucaaccacaugggcaucugcuccugcggccucuacaagcaccccggcguccccgucaaguggaagcgcuga

SEQ ID NO: 1249 - RNA, 1473 nt, Artificial Sequence
  derived and/or modified CDS sequence (opt2) from Lassa virus__AIT17580__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgaguccaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1250 - RNA, 1473 nt, Artificial Sequence
  derived and/or modified CDS sequence (opt2) from Lassa virus__AIT17584__GPC
augggccagaucaucaccuucuuccaggaggucccccaggucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaaccaguccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuucgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaagaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1251 - RNA, 1473 nt, Artificial Sequence
  derived and/or modified CDS sequence (opt2) from Lassa virus__AIT17588__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1252 - RNA, 1473 nt, Artificial Sequence
  derived and/or modified CDS sequence (opt2) from Lassa virus__AIT17592__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacacccucauguccaucaucuccaccuuccaccucuccauccccaacuucaaccaguacgaggccauguccugcgacuucaacggcggccgcaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggccucuacaagcaccccggcguccccgucaaguggaagcgcuga

SEQ ID NO: 1253 - RNA, 1473 nt, Artificial Sequence
  derived and/or modified CDS sequence (opt2) from Lassa virus__AIT17596__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccuccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1254 - RNA, 1473 nt, Artificial Sequence
  derived and/or modified CDS sequence (opt2) from Lassa virus__AIT17600__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccggcgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1255 - RNA, 1473 nt, Artificial Sequence
  derived and/or modified CDS sequence (opt2) from Lassa virus__AIT17604__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacaugaccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaaggaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaagcacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccgucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguaccucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1256 - RNA, 1473 nt, Artificial Sequence
  derived and/or modified CDS sequence (opt2) from Lassa virus__AIT17608__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagcgcaaccucuacaaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggcgccgcuga

SEQ ID NO: 1257 - RNA, 1473 nt, Artificial Sequence
  derived and/or modified CDS sequence (opt2) from Lassa virus__AIT17612__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacauccgcgucggcaacgagaccggccucgagcucacccucaccaacaccuccaucaucaaccacaaguucugcaaccucuccgacgcccacaagaagaaccucuacgaccacucccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggccucuacaagcaccccggcguccccgucaaguggaagcgcuga

SEQ ID NO: 1258 - RNA, 1473 nt, Artificial Sequence
  derived and/or modified CDS sequence (opt2) from Lassa virus__AIT17616__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1259 - RNA, 1473 nt, Artificial Sequence
  derived and/or modified CDS sequence (opt2) from Lassa virus__AIT17620__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucucccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccaucgacgccgccaaccacugcggcaccgucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1260 - RNA, 1473 nt, Artificial Sequence
  derived and/or modified CDS sequence (opt2) from Lassa virus__AIT17626__GPC
augggccagaucaucaccuucuuccaggaggucccccacgucaucgaggaggucaugaacaucguccucaucgcccucucccuccucgccauccucaagggcgucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucauccagcacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucaccguccaguacaaccucucccacuccuacgccaucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcgucugcuccugcggccucuacaagcaccccggcguccccgucaaguggaagcgcuga

SEQ ID NO: 1261 - RNA, 1473 nt, Artificial Sequence
  derived and/or modified CDS sequence (opt2) from Lassa virus__AIT17630__GPC
augggccagaucaucaccuucuuccaggaggucccccacgucaucgaggaggucaugaacaucguccucaucgcccucucccuccucgccauccucaagggcaucuacaacgucgccaccugcggccucuucggccuccucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccgagcacugcggcaccaucgccaacggcguccuccagaccuucaugcgcauggccuggggcggcuccuacaucgcccucgacuccggcaagggcuccugggacugcgucaugaccuccuaccaguaccucaucauccagaacaccuccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1262 - RNA, 1473 nt, Artificial Sequence
  derived and/or modified CDS sequence (opt2) from Lassa virus__AIT17634__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaucuacaaggacgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccaucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacucccgcuacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaaccaccccggcguccccgucaaguggaagcgcuga

SEQ ID NO: 1263 - RNA, 1473 nt, Artificial Sequence
  derived and/or modified CDS sequence (opt2) from Lassa virus__AIT17638__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaaggaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucaucaagauccccacccaccgccacaucaccggcaagcccugccccaagccccaccgccucaaccacaugggcaucugcuccugcggccucuacaagcaccccggcguccccgucaaguggaagcgcuga

SEQ ID NO: 1264 - RNA, 1473 nt, Artificial Sequence
  derived and/or modified CDS sequence (opt2) from Lassa virus__AIT17642__GPC
augggccagaucaucaccuucuuccaggaggucccccacgucaucgaggaggucaugaacaucguccucaucgcccucucccuccucgccauccucaagggcgucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgacaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccucccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1265 - RNA, 1473 nt, Artificial Sequence
  derived and/or modified CDS sequence (opt2) from Lassa virus__AIT17646__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccucccacugcggcaccgucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1266 - RNA, 1473 nt, Artificial Sequence
  derived and/or modified CDS sequence (opt2) from Lassa virus__AIT17650__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaucuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1267 - RNA, 1473 nt, Artificial Sequence
  derived and/or modified CDS sequence (opt2) from Lassa virus__AIT17658__GPC
augggccagaucaucaccuucuuccaggaggucccccacgucaucgaggaggucaugaacaucguccucaucgcccucucccuccucgccauccucaagggcgucuacaacgucgccaccugcggccucuucggccucgucuccuuccuccuccucugcggccgcuccugcuccaucaccuacaagggcgucuacgagcuccagacccucgagcucgacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccggcgacgccgccgaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaugggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaccggcaagcccugccccaagccccaccgccucaaccacaugggcaucugcuccugcggccucuacaagcaccccggcguccccguccgcuggaagcgcuga

SEQ ID NO: 1268 - RNA, 1473 nt, Artificial Sequence
  derived and/or modified CDS sequence (opt2) from Lassa virus__AIT17666__GPC
augggccagaucgucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaccggcaagcccugccccaagccccaccgccucaaccacaugggcaucugcuccugcggccucuacaagcaccccggcguccccgucaaguggaagcgcuga

SEQ ID NO: 1269 - RNA, 1473 nt, Artificial Sequence
  derived and/or modified CDS sequence (opt2) from Lassa virus__AIT17670__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1270 - RNA, 1473 nt, Artificial Sequence
  derived and/or modified CDS sequence (opt2) from Lassa virus__AIT17674__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacaugaccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacaaccacgcccucauguccaucaucuccaccuuccaccucuccauccccaacuucaaccaguacgaggccauguccugcgacuucaacggcggcaagaucuccguccaguacaaccucucccacuccuacgccgucgacgccgccaaccacugcggcaccaucgccaacggcguccuccagaccuucaugcgcauggccuggggcggcuccuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccaggccaacauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1271 - RNA, 1473 nt, Artificial Sequence
  derived and/or modified CDS sequence (opt2) from Lassa virus__AIT17678__GPC
augggccagaucaucaccuucuuccaggaggucccccacgucaucgaggaggucaugaacaucguccucaucacccucucccuccucgccauccucaagggcaucuacaacaucgccaccugcggccucuucggccucgucuccuuccuccuccucugcggccgcuccugcuccaccaccuacaagggcgucuacgagcuccagacccucgagcucgacaugaccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcauccccgucaaguggaagcgcuga

SEQ ID NO: 1272 - RNA, 1473 nt, Artificial Sequence
  derived and/or modified CDS sequence (opt2) from Lassa virus__AIT17686__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacucccgcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucaucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1273 - RNA, 1473 nt, Artificial Sequence
  derived and/or modified CDS sequence (opt2) from Lassa virus__AIT17690__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccucccacugcggcaccgucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1274 - RNA, 1473 nt, Artificial Sequence
  derived and/or modified CDS sequence (opt2) from Lassa virus__AIT17694__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaucuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggccucuacaagcaccccggcguccccgucaaguggaagcgcuga

SEQ ID NO: 1275 - RNA, 1473 nt, Artificial Sequence
  derived and/or modified CDS sequence (opt2) from Lassa virus__AIT17712__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcgccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucaugcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccguccgcuggaagcgcuga

SEQ ID NO: 1276 - RNA, 1473 nt, Artificial Sequence
  derived and/or modified CDS sequence (opt2) from Lassa virus__AIT17718__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacauccgcgucggcaacgagaccggccucgagcucacccucaccaacgccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccaucgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggcuucuacaagcaccccggcguccccgucaaguggaagcgcuga

SEQ ID NO: 1277 - RNA, 1473 nt, Artificial Sequence
  derived and/or modified CDS sequence (opt2) from Lassa virus__AIT17724__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccgucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaugggcaagcccugccccaagccccaccgccucaaccacaugggcaucugcuccugcggccucuacaagcaccccggcguccccgucaaguggaagcgcuga

SEQ ID NO: 1278 - RNA, 1473 nt, Artificial Sequence
  derived and/or modified CDS sequence (opt2) from Lassa virus__AIT17728__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacaugggcucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1279 - RNA, 1473 nt, Artificial Sequence
  derived and/or modified CDS sequence (opt2) from Lassa virus__AIT17732__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcaccccggcguccccgucaaguggaagcgcuga

SEQ ID NO: 1280 - RNA, 1473 nt, Artificial Sequence
  derived and/or modified CDS sequence (opt2) from Lassa virus__AIT17736__GPC
augggccagaucgucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaaggaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucaugcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccgcuucuccgacgacaucgagcagcaggccgacaacaugaucaccgagaugcuccagaaggaguaccucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1281 - RNA, 1473 nt, Artificial Sequence
  derived and/or modified CDS sequence (opt2) from Lassa virus__AIT17744__GPC
augggccagaucaucaccuucuuccaggaggucccccacgucaucgaggaggucaugaacaucguccucaucgcccucucccuccucgccauccucaagggcaucuacaacgucgccaccugcggccucuucggccucauguccuuccuccuccucugcggccgcuccugcuccaccaccuacaagggcgucuacgagcuccagacccucgagcucgacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccuccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1282 - RNA, 1473 nt, Artificial Sequence
  derived and/or modified CDS sequence (opt2) from Lassa virus__AIT17752__GPC
augggccagaucaucaccuucuuccacgaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccaucgacgccgccaaccacugcggcaccaucgccaacggcguccuccagaccuucaugcgcauggccuggggcggcuccuacaucgcccucgacuccggccgcggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1283 - RNA, 1473 nt, Artificial Sequence
  derived and/or modified CDS sequence (opt2) from Lassa virus__AIT17756__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaucaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggccgcggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggccgcaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1284 - RNA, 1473 nt, Artificial Sequence
  derived and/or modified CDS sequence (opt2) from Lassa virus__AIT17758__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucaacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagcgcaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaagcacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugcgaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1285 - RNA, 1473 nt, Artificial Sequence
  derived and/or modified CDS sequence (opt2) from Lassa virus__AIT17762__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucucccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgaggcccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacucccgcuacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1286 - RNA, 1473 nt, Artificial Sequence
  derived and/or modified CDS sequence (opt2) from Lassa virus__AIT17770__GPC
augggccagaucgucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccaggcccucgagcucgacauguccucccucaacaugaccaugccccucuccugcaccaagaacaacucccaccacuacaucauggucggcaacgagaccggccucgagcucacccucaccaacaccuccaucauccaccacaaguucugcaaccucuccgacgcccacaagaaggaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcggcugggacugcaucaugaccuccuaccaguuccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucaagcgccucaagaccgaggcccagauguccauccaccucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccguccgcuggaagcgcuga

SEQ ID NO: 1287 - RNA, 1473 nt, Artificial Sequence
  derived and/or modified CDS sequence (opt2) from Lassa virus__AIT17778__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccaaccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgcccgcgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagaugaacauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacgucaucggcaagcccugccccaagccccaccgccucaaccacaugggcaucugcuccugcggccucuacaagcaccccggcguccccgucaaguggaagcgcuga

SEQ ID NO: 1288 - RNA, 1473 nt, Artificial Sequence
  derived and/or modified CDS sequence (opt2) from Lassa virus__AIT17782__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucaagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacaucgaccgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggccucuacaagcaccccggcguccccgucaaguggaagcgcuga

SEQ ID NO: 1289 - RNA, 1473 nt, Artificial Sequence
  derived and/or modified CDS sequence (opt2) from Lassa virus__AIT17786__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacgccuacgccaucgacgccgccgaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaccggcaagcccugccccaagccccaccgccucaaccacaugggcaucugcuccugcggccucuacaagcaccccggcguccccgucaaguggaagcgcuga

SEQ ID NO: 1290 - RNA, 1473 nt, Artificial Sequence
  derived and/or modified CDS sequence (opt2) from Lassa virus__AIT17790__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagcuccuccagaaggaguacauggaccgccagggcaagaccccccucggccucgucgaccucuucgucuucuccaccuccuucuaccucaucuccaucuuccuccaccucgucaagauccccacccaccgccacaucaccggcaagcccugccccaagccccaccgccucaaccacaugggcaucugcuccugcggccucuacaagcaccccggcguccccgucaaguggaagcgcuga

SEQ ID NO: 1291 - RNA, 1473 nt, Artificial Sequence
  derived and/or modified CDS sequence (opt2) from Lassa virus__AIT17798__GPC
augggccagaucaucaccuucuuccaggaggucccccacgucaucgaggaggucaugaacaucguccucaucgcccucucccuccucgccauccucaagggcaucuacaacgucgccaccugcggccucuucggccucgucuccuuccuccuccucugcggccgcuccugcuccaccaccuacaagggcgucuacgagcuccagacccucgagcucgacauggccucccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccgucgacgccgccaaccacugcggcaccaucgccaacggcguccuccagaccuucaugcgcauggccuggggcggcuccuacaucgcccucgacuccggcaagggcuccugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccaucaugcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccucccccgcugcuggcucgucuccaacggcuccuaccucaacgagacccacuucuccgacgacaucgagcagcaggccgacaacaugaucaccgagaugcuccagaaggaguaccucgaccgccagggcaagaccccccucggccucgucgaccucuucgucuucuccaccuccuucuaccucaucuccaucuuccuccaccucgucaagauccccacccaccgccacaucaucggcaagcccugccccaagccccaccgccucaaccacaugggcaucugcuccugcggccucuacaagcaccccggcguccccgucaaguggaagcgcuga

SEQ ID NO: 1292 - RNA, 1476 nt, Artificial Sequence
  derived and/or modified CDS sequence (opt2) from Lassa virus__AIT17802__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacaaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccucggcaagaccccccucggccucgucgaccucuucgucuucuccaccuccuucuaccucaucuccaucuuccuccaccucgucaagauccccacccaccgccacaucgucggccgcuccugccccaagccccaccgccucaaccacaugggcaucugcuccugcggccucuacaagcagcccggcguccccgucaaguggaagcgcuga

SEQ ID NO: 1293 - RNA, 1476 nt, Artificial Sequence
  derived and/or modified CDS sequence (opt2) from Lassa virus__AIT17806__GPC
augggccagaucgucaccuucuuccaggaggucccccacgucaucgaggaggucaugaacaucguccucaucgcccucuccauccucgccguccucaagggccucuacaacuucgccaccugcggccucaucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1294 - RNA, 1476 nt, Artificial Sequence
  derived and/or modified CDS sequence (opt2) from Lassa virus__AIT17810__GPC
augggccagaucgucaccuucuuccaggaggucccccacgucaucgaggaggucaugaacaucguccucaucgcccucuccauccucgccguccucaagggccucuacaaccucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaaggacaacucccaccacuacauccgcgucggcaacgagaccggccucgagcucacccucaccaacaccuccauccucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggccgcaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccucccccgcugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggccucuacaagcagcccggcguccccgucaaguggaagcgcuga

SEQ ID NO: 1295 - RNA, 1476 nt, Artificial Sequence
  derived and/or modified CDS sequence (opt2) from Lassa virus__AIT17814__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucgaccacaaguucugcaaccucuccgacgcccaccgcaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccaaggacgccgccgaccacugcggcaccgucgccaacggcguccuccagaccuucaugcgcauggccuggggcggcuccuacaucgcccucgacuccggccgcggccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1296 - RNA, 1476 nt, Artificial Sequence
  derived and/or modified CDS sequence (opt2) from Lassa virus__AIT17820__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccgaggacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1297 - RNA, 1476 nt, Artificial Sequence
  derived and/or modified CDS sequence (opt2) from Lassa virus__AIT17824__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccuccgucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccacggcaagugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccguccgcuggaagcgcuga

SEQ ID NO: 1298 - RNA, 1476 nt, Artificial Sequence
  derived and/or modified CDS sequence (opt2) from Lassa virus__AIT17828__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaccucccucuacaagggcgacuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccgucaaguggaagcgcuga

SEQ ID NO: 1299 - RNA, 1473 nt, Artificial Sequence
  derived and/or modified CDS sequence (opt2) from Lassa virus__AIT17836__GPC
augggccagaucaucaccuucuuccaggaggucccccacgucaucgaggaggucaugaacaucguccucaucgcccucucccuccucgccauccucaagggccucuacaacaucgccaccugcggcaucaucggccucgucgccuuccucuuccucugcggcaaguccugcucccucacccucaagggcggcuacgagcuccagacccucgagcucaacauggagacccucaacaugaccaugccccucuccugcaccaagaacuccucccaccacuacauccgcgucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccgagcacugcggcaccgucgccaacggcguccuccagaccuucaugcgcauggccuggggcggccgcuacaucgcccucgacuccggcaagggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccuccuccggccgcaccucccuccccaagugcuggcucaucuccaacggcuccuaccucaacgagacccaguucuccgacgacaucgagcagcaggccgacaacaugaucaccgagaugcuccagaaggaguacaucgagcgccagggcaagaccccccucggccucgucgacaucuucaucuucuccaccuccuucuaccucaucuccaucuuccuccaccucaucaagauccccacccaccgccacaucgucggcaagcccugccccaagccccaccgccucaaccacaugggcgucugcuccugcggccucuacaagcaccccggcguccccaccaaguggaagcgcuga

SEQ ID NO: 1300 - RNA, 1476 nt, Artificial Sequence
  derived and/or modified CDS sequence (opt2) from Lassa virus__AIT17840__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaucucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1301 - RNA, 1476 nt, Artificial Sequence
  derived and/or modified CDS sequence (opt2) from Lassa virus__AIT17844__GPC
augggccagaucgucaccuucuuccaggaggucccccacgucaucgaggaggucaugaacaucguccucaucgcccucuccauccucgccguccucaagggccucuacaacuucgccaccugcggccucgucggccucgucaccuuccuccuccucugcggccgcuccugcaccaucucccucuacaagggcgucuacgagcuccagacccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacuccuacgccggcgacgccgccaaccacugcggcaccgucgccaacggcguccuccagaccuucaugcgcauggccuggggcggcuccuacaucgcccucgacuccggccgcgaccgcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaaccgcgccgucaacgcccucaucaacgaccagcucaucaugaagaaccaccuccgcgacaucaugggcauccccuacugcaacuacuccaaguacugguaccucaaccacaccaccaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccgucaaguggaagcgcuga

SEQ ID NO: 1302 - RNA, 1473 nt, Artificial Sequence
  derived and/or modified CDS sequence (opt2) from Lassa virus__AMR44577__GPC
augggccagaucaucaccuucuuccaggaggucccccacgucaucgaggaggucaugaacaucguccucaucgcccucucccuccucgccauccucaagggcgucuacaacgucgccaccugcggcaucaucggccucgucaccuuccucuuccucugcggccgcuccugcucccucaucuacaagggcuccuacgagcuccagacccucgagcucaacauggagacccucaacaugaccaugccccucuccugcaccaagaacuccucccaccacuacauccgcgucggcaacgagaccggccucgagcucacccucaccaacaccuccaucaucaaccacaaguucugcaaccucuccgacgcccacaagcgcaaccucuacgaccacgcccucauguccauccucuccaccuuccaccucuccauccccaacuucaaccaguacgaggccauguccugcgacuucaacggcggcaagaucuccguccaguacaaccucucccacgccuacgccgucgacgccgccgagcacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaguccgaggcccagauguccauccagcucaucaacaaggccgucaacgcccucaucaacgaccagcucaucaugaagaaccaccuccgcgacaugaugggcauccccuacugcaacuacuccaaguacugguaccucaaccacaccuccuccggccgcaccucccuccccaagugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucaucaagauccccacccaccgccacaucgucggcaagcccugccccaagccccaccgccucaaccacaugggcaucugcuccugcggccucuacaagcagcccggcguccccacccgcuggaagcgcuga

SEQ ID NO: 1303 - RNA, 1476 nt, Artificial Sequence
  derived and/or modified CDS sequence (opt2) from Lassa virus__ANH09722__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccuccuccucugcggccgcuccugcaccaccacccucuacaagggcgucuacgagcuccaggcccucgagcucaacauggagacccucaacaugaccaugccccucuccugcaccaagaacaacucccaccacuacauccgcgucggcaacgagaccggccucgagcucacccucaccaacaccucccucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacgacggcaagaucuccguccaguacaaccucucccacaccuacgccggcgacaccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggcuucuacaagcagcccggcguccccguccgcuggaagcgcuga

SEQ ID NO: 1304 - RNA, 1476 nt, Artificial Sequence
  derived and/or modified CDS sequence (opt2) from Lassa virus__ANH09724__GPC
augggccagaucgucaccuucuuccaggaggucccccacgucaucgaggaggucaugaacaucguccucaucgcccucuccauccucgccguccucaagggccucuacaacgucgccaccugcggccucaucggccucgucaccuuccuccuccucugcggccgcuccugcaccaccacccucuacaagggcgucuacgagcuccaggcccucgagcucaacauggagacccucaacaugaccaugccccucuccugcaccaagaacgacucccaccacuacaucauggucggcaacgagaccggccucgagcucacccucaccaacaccuccaucaucucccacaaguucugcaaccucuccgacgcccacaagcagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccggcgacgccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggcuucuacggccagcccggcguccccguccgcuggaagcgcuga

SEQ ID NO: 1305 - RNA, 1476 nt, Artificial Sequence
  derived and/or modified CDS sequence (opt2) from Lassa virus__ANH09728__GPC
augggccagaucgucaccuucuuccaggaggucccccacgucaucgaggaggucaugaacaucguccucaucgcccucuccguccucgccguccucaagggccucuacaacgucgccaccugcggccucaucggccucgucaccuuccuccuccucugcggccgcuccugcaccaccacccucuacaagggcgucuacgagcuccaggcccucgagcucaacaugggcacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaaggaccucuacgaccacgcccucauguccaucaucuccaccuuccaccucuccguccccaacuucaaccaguacgaggccauguccugcgacuucaacggcggcaagaucuccguccaguacaaccucucccacgccuacgccggcgacaccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcgaguacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggcuucuacaagcagcccggcguccccguccgcuggaagcgcuga

SEQ ID NO: 1306 - RNA, 1476 nt, Artificial Sequence
  derived and/or modified CDS sequence (opt2) from Lassa virus__ANH09730__GPC
augggccagaucgucaccuucuuccaggaggucccccacgucaucgaggaggucaugaacaucguccucaucgcccucuccguccucgccguccucaagggccucuacaacgucgccaccugcggccucaucggccucgucaccuuccuccuccucugcggccgcuccugcaccaccacccucuacaagggcgucuacgagcuccaggcccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaaccagggcaagaucuccguccaguacaaccucucccacgccuacgccggcgacgccgccaaccacugcggcaccgucgccaacggcguccuccagaccuucaugcgcauggccuggggcggcuccuacaucgcccucgacuccggccgcggcggcugggacugcaucaugaccuccuaccaguaccucaucauccagaacaccaccugggagaaccacugccaguucucccgccccucccccaucggcuaccucggccuccucucccagcgcacccgcgacaucuacaucucccgccgccuccucggcaccuucaccuggacccucuccgacuccgagggcaagggcacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgcuucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggccgcaccccccucggccucgucgaccucuucgucuucuccaccuccuucuaccucaucuccaucuuccuccaccucgucaagauccccacccaccgccacgucgucggcaagcccugccccaagccccaccgccucaaccacaugggcaucugcuccugcggcuucuacaagcagcccggcguccccguccgcuggaagcgcuga

SEQ ID NO: 1307 - RNA, 1476 nt, Artificial Sequence
  derived and/or modified CDS sequence (opt2) from Lassa virus__ANH09732__GPC
augggccagaucgucaccuucuuccaggaggucccccacgucaucgaggaggucaugaacaucguccucaucgcccucuccauccucgccguccucaagggcgucuacaacgucgccaccugcggccucaucggccucgucaccuuccuccuccucuccggccgcuccugcaccaccaccaucuacaagggcgucuacgagcuccaggcccucgagcucaacauggagacccucaacaugaccaugccccucuccugcaccaagaacaacucccaccacuacaucauggucggcaacgagaccggccucgagcucacccucaccaacaccuccaucaucaaccacaaguucugcaaccucuccgacgcccacaagaagaaccucuacgaccacgcccucauguccaucaucuccaccuuccaccucuccauccccaacuucaaccaguacgaggccauguccugcgacuucaacggcggcaagaucuccguccaguacaaccucucccacaccuacgccggcgacgccgccaaccacugcggcaccgucgccaacggcguccuccagaccuucaugcgcauggccuggggcggcuccuacaucgcccucgacuccggccacggcggcugggacugcaucaugaccuccuaccaguaccucaucauccagaacaccaccugggagaaccacugccaguucucccgccccucccccaucggcuaccucggccuccucucccagcgcacccgcgacaucuacaucucccgccgccuccucggcaccuucaccuggacccucuccgacuccgagggcaaggacacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaaggccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccgucaccggcaagaccucccuccccaagugcuggcucgucuccaacggcuccuaccucaacgagacccacuucuccgacgacaucgagcagcaggccgacaacaugaucaccgagaugcuccagaaggaguacauggagcgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggcuucuacaagcagcccggcguccccguccgcuggaagcgcuga

SEQ ID NO: 1308 - RNA, 1473 nt, Artificial Sequence
  derived and/or modified CDS sequence (opt2) from Lassa virus__ANH09738__GPC
augggccagaucgucaccuucuuccaggaggucccccacgucaucgaggagaucaugaacaucguccucaucacccucucccuccucgccauccucaagggccucuacaacuucgccaccugcggccucaucggccucaucaccuuccucuuccucugcggccgcuccugcuccaugaucuacaagggcuccuaccagcucgagacccucgagcucaacauggagacccucaacaugaccaugccccucuccugcaccaagaacaacucccaccacuacauccgcgucggcaacgagaccggccucgagcucacccucaccaacaccuccaucaucaaccacaaguucugcaaccucuccgacgcccacaagcgcaaccucuacgaccacucccucauguccaucaucuccaccuuccaccucuccauccccaacuucaaccaguacgaggccauguccugcgacuucaacggcggcaagaucuccauccaguacaaccucucccacaccuacgccggcgacgccgccaagcacugcggcaccgucgccaacggcguccuccagaccuucaugcgcauggccuggggcggcuccuacaucgcccucgacuccggccgcggcaacugggacugcaucaugaccuccuaccaguaccucaucauccagaacaccaccugggaggaccacugccaguucucccgccccucccccaucggcuaccucggccuccucucccagcgcacccgcgacaucuacaucucccgccgccuccucggcaccuucaccuggacccucuccgacuccgagggcaaggagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccagcgccucaagaccgaggcccagauguccauccagcucaucaacaaggccgucaacgcccucaucaacgaccagcucaucaugaagaaccaccuccgcgacaucaugggcauccccuacugcaacuacuccaaguacugguaccucaaccacaccuccaccggccgcaccucccuccccaagugcuggcucgucuccaacggcuccuaccucaacgagacccacuucuccgacgacaucgagcagcaggccgacaacaugaucaccgagaugcuccagaaggaguacaucgaccgccagggcaagaccccccucggccucgucgacgucuucauguucuccaccuccuucuaccucaucuccaucuuccuccaccucgucaagauccccacccaccgccacaucgucggcaaguccugccccaagccccaccgccucaaccacaugggcaucugcuccugcggccucuacaagcagcccggcguccccguccgcuggaagcgcuga

SEQ ID NO: 1309 - RNA, 1473 nt, Artificial Sequence
  derived and/or modified CDS sequence (opt2) from Lassa virus__ANH09740__GPC
augggccagaucgucaccuucuuccaggaggucccccacgucaucgaggaggucaugaacaucguccucaucgcccucucccuccucgccauccucaagggccucuacaacuucgccaccugcggcgucaucggccucaucaccuuccuccuccucugcggccgcuccugcuccgccaccuacaagggccaguacgagcuccagacccucgagcucaacauggagucccucaacaugaccaugccccucuccugcaccaagaacaacucccaccacuacauccgcgccggcaacaacaccggccucgagcucacccucaccaacaccuccaucaucucccacaaguucugcaaccucuccgacgcccacaagaagaaccucuacgaccacacccucauguccaucaucaccaccuuccaccucuccauccccaacuucaaccaguacgaggccauguccugcgacuucaacggcggcaagaucuccauccaguacaaccucucccacuccuacgccggcgacgccgcccagcacugcggcaccgucgccaacggcguccuccagaccuucaugcgcauggccuggggcggcuccuaccucgcccucgacuccggccgccgcggcugggacugcaucaucuccuccuaccaguaccucaucauccagaacaccaccugggacgaccacugccaguucucccgccccucccccaucggcuaccucggcuucgucucccagaagacccgcgacaucuacaucucccgccgccuccucggcaccuucaccuggacccucuccgacuccgagggccacgacaugcccggcggcuacugccucacccgcuggaugcucaucgaggccgaccucaagugcuucggcaacaccgccgucgccaagugcaacgagaagcacgacgaggaguucugcgacauguggcgccucuucgacuucaacaagcaggccauccagcgccucaaggccgaggcccagaugaacauccagcucaucaacaaggccgucaacgcccucaucaacgaccagcucaugaugaagaaccaccuccgcgacaucaugggcauccccuacugcaacuacuccaaguucugguaccucaacaacaccaccaccggccgcaccucccucccccgcugcuggcucaucuccaacggcuccuaccucaacgagacccacuucuccgacgacaucgagcagcaggccgacaacaugaucaccgagaugcuccagaaggaguacauggaccgccagggcaagaccccccucggccucgucgaccucuucgucuucuccaccuccuucuaccucaucaccaucuuccuccaccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1310 - RNA, 1473 nt, Artificial Sequence
  derived and/or modified CDS sequence (opt2) from Lassa virus__CAA36645__GPC
augggccagaucgucaccuucuuccaggaggucccccacgucaucgaggaggucaugaacaucguccucaucgcccucuccauccucgccauccucaagggccucuacaacgucgccaccugcggccucaucggccucgucaccuuccuccuccucuccggccgcuccugcucccucaucuacaagggcaccuacgagcuccagacccucgagcucaacauggagacccucaacaugaccaugccccucuccugcaccaagaacaacucccaccacuacauccgcgucggcaacgagaccggccucgagcucacccucaccaacaccuccauccucaaccacaaguucugcaaccucuccgacgcccacaagcgcaaccucuacgaccacucccucauguccaucaucuccaccuuccaccucuccauccccaacuucaaccaguacgaggccauguccugcgacuucaacggcggcaagaucaccguccaguacaaccucucccacuccuucgccgucgacgccgccggccacugcggcacccucgccaacggcguccuccagaccuucaugcgcauggccuggggcggcuccuacaucgcccucgacuccggccgcggcaacugggacugcaucaugaccuccuaccaguaccucaucauccagaacaccaccugggacgaccacugccaguucucccgccccucccccaucggcuaccucggccuccucucccagcgcacccgcgacaucuacaucucccgccgccuccucggcaccuucaccuggacccucuccgacuccgagggcaacgagacccccggcggcuacugccucacccgcuggaugcucaucgaggccgagcucaagugcuucggcaacaccgccgucgccaagugcaacgagaagcacgacgaggaguucugcgacaugcuccgccucuucgacuucaacaagcaggccauccgccgccucaagaccgaggcccagauguccauccagcucaucaacaaggccgucaacgcccucaucaacgaccagcucaucaugaagaaccaccuccgcgacaucaugggcauccccuacugcaacuacucccgcuacugguaccucaaccacaccuccaccggcaagaccucccucccccgcugcuggcucaucuccaacggcuccuaccucaacgagaccaaguucuccgacgacaucgagcagcaggccgacaacaugaucaccgagaugcuccagaaggaguacaucgaccgccagggcaagaccccccucggccucgucgaccucuucgucuucuccaccuccuucuaccucaucuccaucuuccuccaccucgucaagauccccacccaccgccacaucgucggcaagcccugccccaagccccaccgccucaaccacaugggcaucugcuccugcggccucuacaagcagcccggcguccccguccgcuggaagcgcuga

SEQ ID NO: 1311 - RNA, 1476 nt, Artificial Sequence; identical to SEQ ID NO: 1131
  derived and/or modified CDS sequence (opt2) from Lassa virus__NP_694870__GPC

SEQ ID NO: 1312 - RNA, 1713 nt, Artificial Sequence
  derived and/or modified CDS sequence (opt2) from Lassa virus__AAA46284__NP
auguccgccuccaaggagguccgcuccugccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccguccuccgcgucggcacccucuccuccgacgaccuccucauccucgccgccgaccucgagaagcucaaguccaaggucacccgcaccgagcgcccccucuccuccggcgucuacaugggcaaccucuccucccagcagcucgaccagcgccgcgcccuccucaacaugaucggcaugaccggcgucuccggcggcggcaagggcgccuccaacggcaucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucucccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucgucuccgacacccccggcgagcgcaaccccuacgagaacauccucuacaagaucugccucuccggcgacggcugguccuacaucgccucccgcaccuccaucgucggccgcgccugggagaacaccgucgucgaccucgagcaggacaacaagccccagaagaucggcaacggcggcuccaacaagucccuccaguccgccggcuucgccgccggccucaucuacucccagcucaugacccucaaggacuucaagugcuucaaccucauccccaacgccaagaccuggauggacaucgagggccgccccgaggaccccgucgagaucgcccucuaccagcccuccuccggcugcuacguccacuucuuccgcgagcccaccgaccucaagcaguucaagcaggacgccaaguacucccacggccgcgacgucaccgaccucuucgccgcccagcccggccucaccuccgccgucaucgaggcccucccccgcaacauggucaucaccugccagggcuccgaggacauccgcaagcuccucgagucccagggccgccgcgacaucaagcucaucgacaucacccucuccaaggccgacucccgcaaguucgagaacgccgucugggaccaguucaaggaccucugccacaugcacaccggcgucgucgucgagaagaagaagcgcggcggcaaggaggagaucaccccccacugcgcccucauggacugcaucauguucgacgccgccgucuccggcggccucgacgccaagguccuccgcgucguccucccccgcgacauggucuuccgcaccuccacccccaaggucguccucuga

SEQ ID NO: 1313 - RNA, 1710 nt, Artificial Sequence
  derived and/or modified CDS sequence (opt2) from Lassa virus__AAF86704__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucaacaacguccagcgccucaugcgcaagcagaagcgcgacgacggcgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucucccucuccaaggucgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguucgacgccgccgucuccggcggccucaacauccccguccuccgcgccguccucccccgcgacauggucuuccgcaccuccucccccaaggucguccucuga

SEQ ID NO: 1314 - RNA, 1710 nt, Artificial Sequence
  derived and/or modified CDS sequence (opt2) from Lassa virus__AAO59513__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcuccgcuccaaggucacccgcaccgagcgcccccucuccgccggcgucuacaugggcaaccucuccucccagcagcucgaccagcgccgcgcccuccucuccaugaucggcaugaacggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacgucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacgagaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacaucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucaacaaggccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaagacccucguccuccgcgccguccucccccgcgacauggucuuccgcaccuccaccccccgcgucguccucuga

SEQ ID NO: 1315 - RNA, 1710 nt, Artificial Sequence
  derived and/or modified CDS sequence (opt2) from Lassa virus__AAT48999__NP
auguccgucuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccagaccggccgcgacggcgucguccgcaucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcgagaagccccagaagaucggcuccaacaacuccaacaagugccuccaguccgccggcuucaccgccggccucuccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaugaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacaccuccguccuccgcgccguccucccccgcgacauggucuuccgcaccuccacccccaaggucguccucuga

SEQ ID NO: 1316 - RNA, 1710 nt, Artificial Sequence
  derived and/or modified CDS sequence (opt2) from Lassa virus__AAT49007__NP
auguccgucuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcaucuacaugggcaaccucuccucccagcagcucgaccagcgccgcgcccuccucaacaugaucggcauguccggcggcaaccagggcgcccagaccggccgcgacggcgucguccgcaucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcgagaagccccagaagaucggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaugaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgccuccggcggccucaacacccucguccuccgcgccguccucccccgcgacauggucuuccgcaccuccacccccaaggucguccucuga

SEQ ID NO: 1317 - RNA, 1710 nt, Artificial Sequence
  derived and/or modified CDS sequence (opt2) from Lassa virus__AAT49009__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaaguccguccuccgcgucggcacccucaacuccgacgaccuccucguccucgccgccgaccucgagaagcucaaguccaaggucauccgcaccgagcgcccccucuccuccggcaucuacaugggcaaccucuccucccagcagcucgaccagcgccgcgcccuccucaacaugaucggcaugaccggcggcaaccgcggcggcggcaccuccuccgacggcaucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccaucgacggcauccucaagaccauccucaaggucaagaagucccucggcauguucaucuccgacguccccggcgagcgcaaccccuacgagaacauccucuacaagaucugccucuccggcgacggcuggcccuacaucgccucccgcaccuccaucgucggccgcgccugggagaacaccgucgucgaccucgaguccgacaacaagccccagaagaccggcaacggcggcuccaacaagucccuccaguccgccggcuucgccgccggccucaccuacucccagcucaugacccucaaggacuccaugcuccagcucgaccccaacuccaagaccuggauggacaucgagggccgccccgaggaccccgucgagaucgcccucuaccagcccaacuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacauccgcaagcuccucgagucccagggccgccgcgacaucaagcucaucgacaucucccucaacaaggccgacucccgcaaguucgagaacgccgucugggaccaguucaaggaccucugccacaugcacaccggcgucgucgucgagaagaagaagcgcggcggcaaggaggagaucaccccccacugcgcccucauggacugcaucauguucgacgccgccgucuccggcggccucgacgccaagguccuccgcgccguccucccccgcgacauggucuuccgcaccuccacccccaaggucguccucuga

SEQ ID NO: 1318 - RNA, 1710 nt, Artificial Sequence
  derived and/or modified CDS sequence (opt2) from Lassa virus__ADI39452__NP
auguccgucuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaagaccaaggucacccgcaccgagcgcccccucuccgccggcgucuacaugggcaaccucuccucccagcagcucgagcagcgccgcgcccuccucaacaugaucggcaugaacggcggcaaccagggcguccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagcgcacccucggcauguucgucuccgacacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaaggucggcaacaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacguccgcaagcuccucgagucccagggccgcaaggacaucaagcucaucgacaucgcccucuccaaggccgacucccgcaaguacgagaacgccgucugggaccaguacaaggaccucugccacaugcacaccggcgucgucgucgagaagaagaagcgcggcggcaaggaggagaugaccccccacugcgcccucauggacugcaucauguucgacgccgccgucuccggcggccucuccacccagguccuccgcgccguccucccccgcgacauggucuuccgcaccuccacccccaaggucguccucuga

SEQ ID NO: 1319 - RNA, 1710 nt, Artificial Sequence
  derived and/or modified CDS sequence (opt2) from Lassa virus__ADU56611__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgcaaggcccuccucuccaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuucuccgcccagcccggccucaccuccgccgucaucgaggcccucccccgcaacaugguccucaccugccagggcuccgacgacaucaagaagcuccucgacucccagggccgccgcgacaucaagcucaucgacaucucccucaacaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguucgacgccgccgucuccggcggccucaacauccccauccuccgcgccguccucccccgcgacauggucuuccgcaccuccucccccaaggucguccucuga

SEQ ID NO: 1320 - RNA, 1710 nt, Artificial Sequence
  derived and/or modified CDS sequence (opt2) from Lassa virus__ADU56615__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcaucggcacccucuccuccgacgaccuccucauccucgccgccgaccucgagaagcucaaguccaaggucguccgcaccgagcgcccccucuccuccggcaucuacaugggcaaccucuccucccagcagcucgaccagcgcaaggcccuccucaacaugaucggcaugaccggcggcaacggcggccgcaacgccaccuccgacggcaucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagcgcucccucggcauguucaucuccgacacccccggcgagcgcaaccccuacgagaacauccucuacaagaucugccucuccggcgacggcuggcccuacaucgccucccgcaccuccaucgucggccgcgccugggagaacaccgucgucgaccucgagaccgacaacaagccccagaagaccggcaacggcggcuccaacaagucccuccaguccgccggcuucgccgccggccucaccuacucccagcucaugacccucaaggacuccaugcuccagcucgaccccaacgccaagaccuggauggacaucgagggccgccccgaggaccccgucgagaucgcccucuaccagcccgucuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacauccgcaagcuccucgagucccagggccgccgcgacaucaagcucaucgacaucucccucuccaaggucgacucccgcaaguucgagaacgccgucugggaccaguucaaggaccucugccacaugcacaccggcaucgucgucgagaagaagaagcgcggcggcaaggaggagaucaccccccacugcgcccucauggacugcaucauguucgacgccgccgucuccggcggcgucgacgccaagguccuccgcgccguccucccccgcgacauggucuuccgcaccuccacccccaaggucguccucuga

SEQ ID NO: 1321 - RNA, 1710 nt, Artificial Sequence
  derived and/or modified CDS sequence (opt2) from Lassa virus__ADU56619__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccguccuccgcgucggcacccucuccuccgacgaccuccucguccucgccgccgaccucgagaagcucaaguccaaggucguccgcaccgagcgcccccucuccuccggcaucuacaugggcaaccucuccucccagcagcucgaccagcgcaaggcccuccucaacaugaucggcaugaccggcggcaacggcggccgcaacaccaccuccgacggcaucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagcgcucccucggcauguucaucuccgacacccccggcgagcgcaaccccuacgagaacauccucuacaagaucugccucuccggcgacggcuggcccuacaucgccucccgcaccuccaucgucggccgcgccugggagaacaccgucgucgaccucgaguccgacaacaagccccagaagaccggcaacggcggcuccaacaagucccuccaguccgccggcuucgccgccggccucaccuacucccagcucaugacccucaaggacuccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacauccgcaagcuccucgagucccagggccgccgcgacaucaagcucaucgacaucucccucuccaaggucgacucccgcaaguucgagaacgccgucugggaccaguucaaggaccucugccacaugcacaccggcaucgucgucgagaagaagaagcgcggcggcaaggaggagaucaccccccacugcgcccucauggacugcaucauguucgacgccgccgucuccggcggcgucgacgccaagguccuccgcgccguccucccccgcgacauggucuuccgcaccuccacccccaaggucguccucuga

SEQ ID NO: 1322 - RNA, 1710 nt, Artificial Sequence
  derived and/or modified CDS sequence (opt2) from Lassa virus__ADU56623__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaaccucaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccacaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1323 - RNA, 1710 nt, Artificial Sequence
  derived and/or modified CDS sequence (opt2) from Lassa virus__ADU56627__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucaacacccagcagcucgagcagcgccgcgcccuccucaacaugaucggcauggccggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1324 - RNA, 1710 nt, Artificial Sequence
  derived and/or modified CDS sequence (opt2) from Lassa virus__ADU56631__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1325 - RNA, 1710 nt, Artificial Sequence
  derived and/or modified CDS sequence (opt2) from Lassa virus__AFY05580__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcuccgcuccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucuccaaccaguucggcaccauccccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1326 - RNA, 1710 nt, Artificial Sequence
  derived and/or modified CDS sequence (opt2) from Lassa virus__AFY05581__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucuccaaccaguucggcaccauccccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccucaaggccguccucccccgcgacauggucuuccgcaccuccaccccccgcgucguccucuga

SEQ ID NO: 1327 - RNA, 1710 nt, Artificial Sequence
  derived and/or modified CDS sequence (opt2) from Lassa virus__AFY05587__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcuccgcuccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucuccaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1328 - RNA, 1710 nt, Artificial Sequence
  derived and/or modified CDS sequence (opt2) from Lassa virus__AFY05591__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgucgagcuccucuccaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1329 - RNA, 1710 nt, Artificial Sequence
  derived and/or modified CDS sequence (opt2) from Lassa virus__AFY05597__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucuccaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1330 - RNA, 1710 nt, Artificial Sequence
  derived and/or modified CDS sequence (opt2) from Lassa virus__AFY05610__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucuccaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacaacuccuccaagucccuccaguccgccggcuucaccgccggccucaccuacucccagcucaugacccucaaggacgccaugcuccagcucgaccccaacaccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1331 - RNA, 1710 nt, Artificial Sequence
  derived and/or modified CDS sequence (opt2) from Lassa virus__AFY05616__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucuccaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1332 - RNA, 1716 nt, Artificial Sequence
  derived and/or modified CDS sequence (opt2) from Lassa virus__AFY05618__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcuccgcuccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucuccaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcagaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1333 - RNA, 1710 nt, Artificial Sequence
  derived and/or modified CDS sequence (opt2) from Lassa virus__AHC95552__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaagaacguccuccgcgucggcacccucaacuccgacgaccuccucacccucgccgccgaccucgagaagcucaaguccaaggucacccgcaccgagcgcccccucuccuccggcgucuacaugggcaaccucuccucccagcagcucgaccagcgccgcgcccuccucaacaugaucggcaugaccggcggcaaccagggcacccaggccggccgcgacggcgucguccgcgucugggacgucaagaacgccgagcuccucaacaaccaguucggcaccaugcccucccucacccucgccugccucaccaagcagggccaggccgaccucaacgacgucguccaggcccucaccgaccucggccucaucuacaccgccaaguaccccaacgccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccaguccauggacggcauccucaaguccauccucaaggucaagcgcgcccucggcauguucgucuccgacacccccggcgagcgcaaccccuacgagaacauccucuacaagaucugccucuccggcgacggcuggcccuacaucgccucccgcaccuccaucgucggccgcgccugggagaacaccgucgucgaccucgaggccgacggcaaccccaagaagcucaacuccaacggcuccaacaagucccuccaguccgccggcuuccccgccggccucaccuacucccagcucaugacccucaaggacgccaugcuccagcucgaccccaacgccaagaccuggauggacaucgagggccgccccgaggaccccgucgaggucgcccucuaccagcccaacuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacauccgcaagcuccucgagucccagggccgcaaggacaucaagcucaucgacaucgcccucuccaagaccgacucccgcaaguucgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccaccccccgcgucguccucuga

SEQ ID NO: 1334 - RNA, 1710 nt, Artificial Sequence
  derived and/or modified CDS sequence (opt2) from Lassa virus__AHC95554__NP
auguccgccuccaaggagguccgcuccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaaguccguccuccgcgucggcacccucaacuccgacgaccuccucacccucgccgccgaccucgagaagcucaaguccaaggucacccgcaccgagcgcccccucuccuccggcgucuacaugggcaaccucuccucccagcagcucgaccagcgccgcgcccuccucaacaugaucggcaugaccggcggcaaccagggcgcccaggccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaagaucuccccccaguccgucgacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccgucgucgaccucgaggccgacggcaagccccagaagcccaacuccggcuccuccaacaagucccuccaguccgccggcuuccccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacaucaagaagcuccucgagucccagggccgcaaggacaucaagcucaucgacaucgcccucuccaagaucgacucccgcaaguucgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccacccccaaggucguccucuga

SEQ ID NO: 1335 - RNA, 1710 nt, Artificial Sequence
  derived and/or modified CDS sequence (opt2) from Lassa virus__AHC95556__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaagaacguccuccgcgucggcacccucaacuccgacgaccuccucacccucgccgccgaccucgagaagcucaaguccaaggucacccgcaccgagcgcccccucuccuccggcgucuacaugggcaaccucuccucccagcagcucgaccagcgccgcgcccuccucaacaugaucggcaugaccggcggcaaccagggcacccagaccggccgcgacggcgucguccgcgucugggacgucaagaacgccgagcuccucaacaaccaguucggcaccaugcccucccucacccucgccugccucaccaagcagggccaggccgaccucaacgacgucguccaggcccucaccgaccucggccucaucuacaccgccaaguaccccaacgccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccaguccauggacggcauccucaaguccauccucaaggucaagcgcgcccucggcauguucgucuccgacacccccggcgagcgcaaccccuacgagaacauccucuacaagaucugccucuccggcgacggcuggcccuacaucgccucccgcaccuccaucgucggccgcgccugggagaacaccgucgucgaccucgaggccgacggcaaccccaagaagcucaacuccaacggcuccaacaagucccuccaguccgccggcuuccccgccggccucaccuacucccagcucaugacccucaaggacgccaugcuccagcucgaccccaacgccaagaccuggauggacaucgagggccgccccgaggaccccgucgaggucgcccucuaccagcccaacuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacauccgcaagcuccucgagucccagggccgcaaggacaucaagcucaucgacaucgcccucuccaagaccgacucccgcaaguucgagaacgccgucugggaccagcacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1336 - RNA, 1710 nt, Artificial Sequence
  derived and/or modified CDS sequence (opt2) from Lassa virus__AHC95558__NP
auguccgccuccaaggagguccgcuccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucuccuccgacgaccuccucacccucgccgccgaccucgagaagcucaaguccaaggucauccgcaccgagcgcccccucuccuccggcgucuacaugggcaaccucuccucccagcagcucgaccagcgccgcgcccuccucaacaugaucggcaugaccggcggcaaccagggcgcccaggccggccgcgacggcgucguccgcgucugggacguccgcaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagaaccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccaguccaucgacggcauccucaaguccauccucaaggucaagcgcacccucggcauguucgucuccgacacccccggcgagcgcaaccccuacgagaacauccucuacaagaucugccucuccggcgacggcuggcccuacaucgccucccgcaccuccaucgucggccgcgccugggagaacaccgucgucgaccucgagaccgaccgcaagucccagggccccaacuccggcaacuccaacaagucccuccaguccgccggcuucuccgccggccucaccuacucccagcucaugacccucaaggacgccaugcuccagcucgaccccaacgccaagaccuggauggacaucgagggccgccccgaggaccccgucgaggucgcccucuaccagcccaucuccggcugcuacauccacuucuuccgcgagcccaccgaccucaagcaguucaagcaggacgccaaguacucccacggcaucgacaucaccgaccucuucgccgcccagcccggccucaccuccgccgucaucgaggcccucccccgcaacauggucaucaccugccagggcuccgaggacaucaagaagcuccucgagucccagggccgcaaggacaucaagcucaucgacaucgcccucuccaagaucgacucccgcaaguucgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccacccccaaggucguccucuga

SEQ ID NO: 1337 - RNA, 1710 nt, Artificial Sequence
  derived and/or modified CDS sequence (opt2) from Lassa virus__AHC95560__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaagaacguccuccgcgucggcacccucaacuccgacgaccuccucacccucgccgccgaccucgagaagcucaaguccaaggucacccgcaccgagcgcccccucuccuccggcgucuacaugggcaaccucuccucccagcagcucgaccagcgccgcgcccuccucaacaugaucggcauguccggcggcaaccagggcacccaggucggccgcgacggcgucguccgcgucugggacgucaagaacgccgagcuccucaacaaccaguucggcaccaugcccucccucacccucgccugccucaccaagcagggccaggccgaccucaacgacgucguccaggcccucaccgaccucggccucaucuacaccgccaaguaccccaacgccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccaguccauggacggcauccucaaguccauccucaaggucaagcgcgcccucggcauguucgucuccgacacccccggcgagcgcaaccccuacgagaacauccucuacaagaucugccucuccggcgacggcuggcccuacaucgccucccgcaccuccaucgucggccgcgccugggagaacaccgucgucgaccucgaggccgacggcaaccccaagaagcucaacuccaacggcuccaacaagucccuccaguccgccggcuuccccgccggccucaccuacucccagcucaugacccucaaggacgccaugcuccagcucgaccccaacgccaagaccuggauggacaucgagggccgccccgaggaccccgucgaggucgcccucuaccagcccaacuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacauccgcaagcuccucgagucccagggccgcaaggacaucaagcucaucgacaucgcccucuccaagaccgacucccgcaaguucgagaacgccgucugggaccagcacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1338 - RNA, 1710 nt, Artificial Sequence
  derived and/or modified CDS sequence (opt2) from Lassa virus__AIT17127__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucuccaugaucggcauguccggcggcaaccagggcguccgcgccggcaaggacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacaccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1339 - RNA, 1710 nt, Artificial Sequence
  derived and/or modified CDS sequence (opt2) from Lassa virus__AIT17131__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucuccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacauggucgacaccaagaaguccucccucaacaucuccggcuacaacuucucccucggcgccgccgucaaggccggcgccugcaugcucgacggcggcaacaugcucgagaccaucaaggucuccccccagaccaucgacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaucuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcgccgacgacauccgcaagcuccucgagucccagggccgcaaggacaucaagcucaucgacaucgcccucaacaaggccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1340 - RNA, 1710 nt, Artificial Sequence
  derived and/or modified CDS sequence (opt2) from Lassa virus__AIT17139__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacuccauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccaccaccccccgcgucguccucuga

SEQ ID NO: 1341 - RNA, 1710 nt, Artificial Sequence
  derived and/or modified CDS sequence (opt2) from Lassa virus__AIT17143__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcaacaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaaccucgucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1342 - RNA, 1710 nt, Artificial Sequence
  derived and/or modified CDS sequence (opt2) from Lassa virus__AIT17147__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgagcagcgccgcgcccuccucaacaugaucggcauguccggcuccaaccagggcgcccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgucaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacuccuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1343 - RNA, 1710 nt, Artificial Sequence
  derived and/or modified CDS sequence (opt2) from Lassa virus__AIT17151__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagcuccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1344 - RNA, 1710 nt, Artificial Sequence
  derived and/or modified CDS sequence (opt2) from Lassa virus__AIT17155__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgagcuccucguccucgccgccgaccucgagaagcucaaguccaaggucauccgcaccgagcgcccccucuccgccggcgucuacaugggcaaccucuccucccagcagcucgaccagcgccgcgcccuccucuccaugaucggcauguccggcggcaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaucgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacucccucguccuccgcgccguccucccccgcgacauggucuuccgcaccuccaccccccgcgucguccucuga

SEQ ID NO: 1345 - RNA, 1710 nt, Artificial Sequence
  derived and/or modified CDS sequence (opt2) from Lassa virus__AIT17161__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacuccuccaacaagucccuccaguccgccggccucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaaccucgucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1346 - RNA, 1710 nt, Artificial Sequence
  derived and/or modified CDS sequence (opt2) from Lassa virus__AIT17165__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucaacaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccaacggcaaccagggcacccgcgccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccuccaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaaggccgacucccgcaaguacgagaacgccgucugggaccagcacaaggaccucugccacaugcacaccggcgucgucgucgagaagaagaagcgcggcggcaaggaggagaucaccccccacugcgcccucauggacugcaucauguacgacgccgccgucuccggcggccucaacaccuccguccuccgcgccguccucccccgcgacauggucuuccgcaccuccaccccccgcgucguccucuga

SEQ ID NO: 1347 - RNA, 1710 nt, Artificial Sequence
  derived and/or modified CDS sequence (opt2) from Lassa virus__AIT17169__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucuccaugaucggcauguccuccggcaaccagcgcgcccaggccggccgcgacggcgucguccgcgucugggacgucaagaacgucgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgucggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1348 - RNA, 1710 nt, Artificial Sequence
  derived and/or modified CDS sequence (opt2) from Lassa virus__AIT17173__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacgcccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1349 - RNA, 1710 nt, Artificial Sequence
  derived and/or modified CDS sequence (opt2) from Lassa virus__AIT17177__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucauccgcaccgagcgcccccucuccgccggcaucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaagaugaucgacgccaacaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaucggccgcgccugggagaacaccgucgucgaccucgaguccgacggcaagccccagaagaccggcuccaacaacuccuccaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1350 - RNA, 1710 nt, Artificial Sequence
  derived and/or modified CDS sequence (opt2) from Lassa virus__AIT17181__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccggcggcauccagggcacccgcaccggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacgccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagacccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacaucaagaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccaccccccgcgucguccucuga

SEQ ID NO: 1351 - RNA, 1710 nt, Artificial Sequence
  derived and/or modified CDS sequence (opt2) from Lassa virus__AIT17185__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccgcggcgcccgcaccggcaaggacggcgucguccgcaucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaacaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacgagaagccccagaaggccggcuccaacaacuccaacaagucccuccaguccaccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacacccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1352 - RNA, 1710 nt, Artificial Sequence
  derived and/or modified CDS sequence (opt2) from Lassa virus__AIT17189__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccaucgacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacucccucguccuccgcgccguccucccccgcgacauggucuuccgcaccuccaccccccgcgucguccucuga

SEQ ID NO: 1353 - RNA, 1710 nt, Artificial Sequence
  derived and/or modified CDS sequence (opt2) from Lassa virus__AIT17193__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcaacaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacucccucguccuccgcgccguccucccccgcgacauggucuuccgcaccuccaccccccgcgucguccucuga

SEQ ID NO: 1354 - RNA, 1710 nt, Artificial Sequence
  derived and/or modified CDS sequence (opt2) from Lassa virus__AIT17197__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucucccuccagcagcucgaccagcgccgcgcccuccucaacaugaucggcauguccggcuccaaccagggcguccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1355 - RNA, 1710 nt, Artificial Sequence
  derived and/or modified CDS sequence (opt2) from Lassa virus__AIT17201__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacgcccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacaucaagaagcucuucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1356 - RNA, 1710 nt, Artificial Sequence
  derived and/or modified CDS sequence (opt2) from Lassa virus__AIT17205__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgcaaggcccuccucaacaugaucggcauguccggcuccaaccagggcgcccgcaucggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacuccuccaacaagucccuccaguccgccggccucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaaccucgucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1357 - RNA, 1710 nt, Artificial Sequence
  derived and/or modified CDS sequence (opt2) from Lassa virus__AIT17209__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagcuccagaagaccggcuccaacaacuccaacaagucccuccaguccgccggcuucaccgccggccucaccuacucccagcucaugacccucaaggacgccaugcuccagcucgaccccaacgccaagaucuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1358 - RNA, 1710 nt, Artificial Sequence
  derived and/or modified CDS sequence (opt2) from Lassa virus__AIT17211__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccaacuccaacuccuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1359 - RNA, 1710 nt, Artificial Sequence
  derived and/or modified CDS sequence (opt2) from Lassa virus__AIT17213__NP
auguccgccuccaaggagaucaaguccuuccucuggacccagucccuccgccgcgagcucgccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccggcuccaaccagggcguccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1360 - RNA, 1710 nt, Artificial Sequence
  derived and/or modified CDS sequence (opt2) from Lassa virus__AIT17217__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccuccggcguccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccaccggcuucgccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacaucaagaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1361 - RNA, 1710 nt, Artificial Sequence
  derived and/or modified CDS sequence (opt2) from Lassa virus__AIT17225__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggcaacgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaagaccggcaacaacuccuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucuccaagaucgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1362 - RNA, 1710 nt, Artificial Sequence
  derived and/or modified CDS sequence (opt2) from Lassa virus__AIT17229__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucuccaugaucggcauguccggcggcaaccagggcacccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaaggccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1363 - RNA, 1710 nt, Artificial Sequence
  derived and/or modified CDS sequence (opt2) from Lassa virus__AIT17233__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1364 - RNA, 1710 nt, Artificial Sequence
  derived and/or modified CDS sequence (opt2) from Lassa virus__AIT17237__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1365 - RNA, 1710 nt, Artificial Sequence
  derived and/or modified CDS sequence (opt2) from Lassa virus__AIT17241__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1366 - RNA, 1710 nt, Artificial Sequence
  derived and/or modified CDS sequence (opt2) from Lassa virus__AIT17245__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggccucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucgccgaccucuucgccgcccagcccggccucaccuccgccgucaucgacgcccucccccgcaaccucgucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1367 - RNA, 1710 nt, Artificial Sequence
  derived and/or modified CDS sequence (opt2) from Lassa virus__AIT17247__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccuccggcgucuacaugggcaaccucuccucccagcagcucgaccagcgccgcgcccuccucaacaugaucggcauguccggcggcaaccagggcgcccaggucggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaaggccggcuccaacaacuccaacaagucccuccaguccgccggcuucaccgccggccucaccuacucccagcucaugacccucaaggacuccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaagacccucguccuccgcgccguccucccccgcgacauggucuuccgcaccuccacccccaaggucguccucuga

SEQ ID NO: 1368 - RNA, 1710 nt, Artificial Sequence
  derived and/or modified CDS sequence (opt2) from Lassa virus__AIT17251__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccuccggcgucuacaugggcaaccucuccucccagcagcucgaccagcgccgcgcccuccucaacaugaucggcauguccggcggcaaccagggcgcccaggucggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaagaccggcuccaacaacuccaacaagucccuccaguccgccggcuucaccgccggccucaccuacucccagcucaugacccucaaggacuccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaagacccucguccuccgcgccguccucccccgcgacauggucuuccgcaccuccacccccaaggucguccucuga

SEQ ID NO: 1369 - RNA, 1710 nt, Artificial Sequence
  derived and/or modified CDS sequence (opt2) from Lassa virus__AIT17255__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagcgcgcccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgucaaguaccccaacgccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagacccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccaacggcaagccccagaaggccgacuccaacuccuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgccuucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccaccccccgcgucguccucuga

SEQ ID NO: 1370 - RNA, 1710 nt, Artificial Sequence
  derived and/or modified CDS sequence (opt2) from Lassa virus__AIT17259__NP
auguccgccuccaaggagaucaaguccuuccucuggacccagucccuccgccgcgagcucuccuccuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugcucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacuccuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1371 - RNA, 1710 nt, Artificial Sequence
  derived and/or modified CDS sequence (opt2) from Lassa virus__AIT17263__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcaugggcggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacaccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1372 - RNA, 1710 nt, Artificial Sequence
  derived and/or modified CDS sequence (opt2) from Lassa virus__AIT17267__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacuccauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccaccaccccccgcgucguccucuga

SEQ ID NO: 1373 - RNA, 1710 nt, Artificial Sequence
  derived and/or modified CDS sequence (opt2) from Lassa virus__AIT17271__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaagaccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaagaccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaaggccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguacgacgccgccgucuccggcggccucuccaccuccguccuccgcgccguccucccccgcgacauggucuuccgcaccuccaccccccgcgucguccucuga

SEQ ID NO: 1374 - RNA, 1710 nt, Artificial Sequence
  derived and/or modified CDS sequence (opt2) from Lassa virus__AIT17275__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcaccggcaaggacggcgucguccgcaucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaucuccgaccucgaccgccucgcccagucccaccccauccucaagaugaucgacaccuccaaguccucccucaacaucuccggcuacaacuucucccucggcgccgccgucaaggccggcgccugcaugcucgacggcggcaacaugcucgagaccgucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggucggcuccaacaacuccaacaagucccuccaguccaccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacacccucccccgcaacauggucaucaccugccagggcuccgacgacaucggcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1375 - RNA, 1710 nt, Artificial Sequence
  derived and/or modified CDS sequence (opt2) from Lassa virus__AIT17277__NP
auguccgccuccaaggagaucaaguccuuccucuggacccagucccuccgccgcgagcucuccuccuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1376 - RNA, 1710 nt, Artificial Sequence
  derived and/or modified CDS sequence (opt2) from Lassa virus__AIT17281__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcgccggccgcgacggcgucguccgcaucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaagaccuccaccaccaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacacccucccccgcaacauggucaucaccugccagggcuccgaggacauccgccgccuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1377 - RNA, 1710 nt, Artificial Sequence
  derived and/or modified CDS sequence (opt2) from Lassa virus__AIT17285__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgcuccaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacgccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaaggccggcaacaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaaccucgucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1378 - RNA, 1710 nt, Artificial Sequence
  derived and/or modified CDS sequence (opt2) from Lassa virus__AIT17289__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcguccgcgccggccgcgacggcgucguccgcaucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaagaccggcuccaucaacuccaacaagucccuccaguccaccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1379 - RNA, 1710 nt, Artificial Sequence
  derived and/or modified CDS sequence (opt2) from Lassa virus__AIT17293__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccacccagcagcucgaccagcgccgcgcccuccucaacaugaucggcauguccggcggcaaccagggcgcccgcgccggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaacaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcggcaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugcaacaugcacaccggcaucgucgucgagaagaagaagcgcggcggcaaggaggagaucaccccccacugcgcccucauggacugcaucauguucgacgccgccgucuccggcggcaugaacaccuccguccuccgcgccguccucccccgcgacauggucuuccgcaccuccaccccccgcgucguccucuga

SEQ ID NO: 1380 - RNA, 1710 nt, Artificial Sequence
  derived and/or modified CDS sequence (opt2) from Lassa virus__AIT17295__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcaugggcggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccaucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1381 - RNA, 1710 nt, Artificial Sequence
  derived and/or modified CDS sequence (opt2) from Lassa virus__AIT17299__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccuccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacucccucguccuccgcgccguccucccccgcgacauggucuuccgcaccuccaccccccgcgucguccucuga

SEQ ID NO: 1382 - RNA, 1710 nt, Artificial Sequence
  derived and/or modified CDS sequence (opt2) from Lassa virus__AIT17303__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucauccgcaccgagcgcccccucuccuccggcgucuacaugggcaaccucuccucccagcagcucgaccagcgccgcgcccuccucaacaugaucggcauguccggcggcaaccagggcgcccaggucggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucguccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaaggccggcuccaacaacuccaacaagucccuccaguccgccggcuucaccgccggccucaccuacucccagcucaugacccucaaggacuccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaagacccucguccuccgcgccguccucccccgcgacauggucuuccgcaccuccacccccaaggucguccucuga

SEQ ID NO: 1383 - RNA, 1710 nt, Artificial Sequence
  derived and/or modified CDS sequence (opt2) from Lassa virus__AIT17307__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagcuccagaagaccggcuccaacaacuccaacaagucccuccaguccgccggcuucaccgccggccucaccuacucccagcucaugacccucaaggacgccaugcuccagcucgaccccaacgccaagaucuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1384 - RNA, 1710 nt, Artificial Sequence
  derived and/or modified CDS sequence (opt2) from Lassa virus__AIT17311__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcaugggcggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1385 - RNA, 1710 nt, Artificial Sequence
  derived and/or modified CDS sequence (opt2) from Lassa virus__AIT17315__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcgccggccgcgacggcgucguccgcgucugggacgucaagaacgucgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacuccuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagaagggcuccaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1386 - RNA, 1710 nt, Artificial Sequence
  derived and/or modified CDS sequence (opt2) from Lassa virus__AIT17319__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucauccgcaccgagcgcccccucuccuccggcgucuacaugggcaaccucuccucccagcagcucgaccagcgccgcgcccuccucaacaugaucggcauguccggcggcaaccagggcgcccaggucggccgcgacggcgucguccgcgucugggacgucaagaacgccgacaugcucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaaggccggcuccaacaacuccaacaagucccuccaguccgccggcuucaccgccggccucaccuacucccagcucaugacccucaaggacuccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucguccucaacaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaagaccaugguccuccgcgccguccucccccgcgacauggucuuccgcaccuccacccccaaggucguccucuga

SEQ ID NO: 1387 - RNA, 1710 nt, Artificial Sequence
  derived and/or modified CDS sequence (opt2) from Lassa virus__AIT17323__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucauccgcaccgagcgcccccucuccuccggcgucuacaugggcaaccucuccucccagcagcucgaccagcgccgcgcccuccucaacaugaucggcauguccggcggcaaccagggcgcccaggucggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaaggccggcuccaacaacuccaacaagucccuccaguccgccggcuucaccgccggccucaccuacucccagcucaugacccucaaggacuccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaagacccucguccuccgcgccguccucccccgcgacauggucuuccgcaccuccacccccaaggucguccucuga

SEQ ID NO: 1388 - RNA, 1710 nt, Artificial Sequence
  derived and/or modified CDS sequence (opt2) from Lassa virus__AIT17325__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucaacaugaucggcaugaccggcggcucccgcggcgcccaggccggcggcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcggcaacaacuccaacaagucccuccaguccgccggcuucaccgccggccucaccuacucccagcucaugacccucaaggacaccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucuccaaggucgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1389 - RNA, 1710 nt, Artificial Sequence
  derived and/or modified CDS sequence (opt2) from Lassa virus__AIT17329__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccagaccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccuccggcaaccagggcgcccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaugccccagaaggccggcuccuccuccuccaacaagucccuccaguccgccggcuucgucgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaaggccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguacgacgccgccgucuccggcggccucaacaccuccguccuccgcgccguccucccccgcgacauggucuuccgcaccuccaccccccgcgucguccucuga

SEQ ID NO: 1390 - RNA, 1710 nt, Artificial Sequence
  derived and/or modified CDS sequence (opt2) from Lassa virus__AIT17333__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacuccauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1391 - RNA, 1710 nt, Artificial Sequence
  derived and/or modified CDS sequence (opt2) from Lassa virus__AIT17335__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccuccggcguccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccaccggcuucgccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacaucaagaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1392 - RNA, 1710 nt, Artificial Sequence
  derived and/or modified CDS sequence (opt2) from Lassa virus__AIT17341__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacgcccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaaggccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1393 - RNA, 1710 nt, Artificial Sequence
  derived and/or modified CDS sequence (opt2) from Lassa virus__AIT17345__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccuccggcguccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacaucaagaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1394 - RNA, 1710 nt, Artificial Sequence
  derived and/or modified CDS sequence (opt2) from Lassa virus__AIT17351__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgagcagcgccgcgcccuccucaacaugaucggcauguccuccggcaaccagggcgcccgcaccggcaaggacggcgucguccgcaucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacauggucgacaccuccaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccaacggcaagccccagaaggccggcuccaacaacuccaacaagucccuccaguccaccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacacccucccccgcaacauggucaucaccugccagggcuccgacgacauccgcaagcuccucgagucccagggccgcaaggacaucaagcucaucgacaucgcccucuccaagaucgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1395 - RNA, 1710 nt, Artificial Sequence
  derived and/or modified CDS sequence (opt2) from Lassa virus__AIT17359__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugcucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacgagaagccccagaaggccggcuccaacuccuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1396 - RNA, 1710 nt, Artificial Sequence
  derived and/or modified CDS sequence (opt2) from Lassa virus__AIT17361__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcaucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaagaccaacaacaccaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacacccucccccgcaacauggucaucaccugccagggcuccgaggacauccgccgccuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1397 - RNA, 1710 nt, Artificial Sequence
  derived and/or modified CDS sequence (opt2) from Lassa virus__AIT17365__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacgcccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1398 - RNA, 1710 nt, Artificial Sequence
  derived and/or modified CDS sequence (opt2) from Lassa virus__AIT17371__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacgcccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacuccuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1399 - RNA, 1710 nt, Artificial Sequence
  derived and/or modified CDS sequence (opt2) from Lassa virus__AIT17379__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccuccggcaaccgcggcgcccaggccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacauggucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1400 - RNA, 1710 nt, Artificial Sequence
  derived and/or modified CDS sequence (opt2) from Lassa virus__AIT17381__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucacccgcaccgagcgcccccucuccgccggcgucuacaugggcaaccucuccucccagcagcucgaccagcgccgcgcccuccucuccaugaucggcauguccggcggcaaccagggcgcccgcgccggccgcgacggcgucguccgcaucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccaucgucgaccucgaguccgacggcaagccccagaagaccuccaacaccaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgaggacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1401 - RNA, 1710 nt, Artificial Sequence
  derived and/or modified CDS sequence (opt2) from Lassa virus__AIT17389__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacggcgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcaccggcaaggacggcgucguccgcaucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccuccaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccaccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacacccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacgucuccguccuccgcgccguccucccccgcgacauggucuuccgcaccuccaccccccgcgucguccucuga

SEQ ID NO: 1402 - RNA, 1710 nt, Artificial Sequence
  derived and/or modified CDS sequence (opt2) from Lassa virus__AIT17399__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucaccuccgacgaccuccucguccucgccgccgaccucgagaagcucaaguccaaggucauccgcaccgagcgcccccucuccuccggcgucuacaugggcaaccucuccucccagcagcucgaccagcgccgcgcccuccucaacaugaucggcauguccggcggcaaccagggcgcccaggucggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucgcccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaaggcccucggcauguucaucuccgagacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcaacaacaacuccaacaagucccuccaguccgccggcuucaccgccggccucaccuacucccagcucaugacccucaaggacuccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgaggcccucccccgcaacauggucaucaccugccagggcuccgacgacauccgcaagcuccucgagucccagggccgcaaggacaucaagcucaucgacaucgcccucaacaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaagacccucgcccuccgcgccguccucccccgcgacauggucuuccgcaccuccacccccaaggucguccucuga

SEQ ID NO: 1403 - RNA, 1710 nt, Artificial Sequence
  derived and/or modified CDS sequence (opt2) from Lassa virus__AIT17405__NP
auguccgucuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaucaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcuccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1404 - RNA, 1710 nt, Artificial Sequence
  derived and/or modified CDS sequence (opt2) from Lassa virus__AIT17409__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucaacaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1405 - RNA, 1710 nt, Artificial Sequence
  derived and/or modified CDS sequence (opt2) from Lassa virus__AIT17413__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacgcccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaagaugggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1406 - RNA, 1710 nt, Artificial Sequence
  derived and/or modified CDS sequence (opt2) from Lassa virus__AIT17421__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucuccggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaucaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaagaugggcuccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1407 - RNA, 1710 nt, Artificial Sequence
  derived and/or modified CDS sequence (opt2) from Lassa virus__AIT17425__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaucgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1408 - RNA, 1710 nt, Artificial Sequence
  derived and/or modified CDS sequence (opt2) from Lassa virus__AIT17429__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacgcccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1409 - RNA, 1710 nt, Artificial Sequence
  derived and/or modified CDS sequence (opt2) from Lassa virus__AIT17431__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccgccucccccaaggucguccucuga

SEQ ID NO: 1410 - RNA, 1710 nt, Artificial Sequence
  derived and/or modified CDS sequence (opt2) from Lassa virus__AIT17439__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaagaugggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccgucuccggcugcuacauccacuucuuccgcgagcccaccgaccucaagcaguucaagcaggacgccaaguacucccacggcaucgacgucgccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccgucuuccgcgccguccucccccgcgacauggucuuccgcaccuccucccccaaggucguccucuga

SEQ ID NO: 1411 - RNA, 1710 nt, Artificial Sequence
  derived and/or modified CDS sequence (opt2) from Lassa virus__AIT17443__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacgcccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1412 - RNA, 1710 nt, Artificial Sequence
  derived and/or modified CDS sequence (opt2) from Lassa virus__AIT17447__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccaccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1413 - RNA, 1710 nt, Artificial Sequence
  derived and/or modified CDS sequence (opt2) from Lassa virus__AIT17451__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguuccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccaccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1414 - RNA, 1710 nt, Artificial Sequence
  derived and/or modified CDS sequence (opt2) from Lassa virus__AIT17455__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucuccaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1415 - RNA, 1710 nt, Artificial Sequence
  derived and/or modified CDS sequence (opt2) from Lassa virus__AIT17459__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaagaugggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccgucuccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1416 - RNA, 1710 nt, Artificial Sequence
  derived and/or modified CDS sequence (opt2) from Lassa virus__AIT17463__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcacaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccaguccacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaccauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaucgucgaccucgagaccgacggcaagccccagaaggucggcaccgccggcuccucccgcucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1417 - RNA, 1710 nt, Artificial Sequence
  derived and/or modified CDS sequence (opt2) from Lassa virus__AIT17467__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcacccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucucccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1418 - RNA, 1710 nt, Artificial Sequence
  derived and/or modified CDS sequence (opt2) from Lassa virus__AIT17471__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaagaugggcaccaccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgcaaguucgagaacgucgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1419 - RNA, 1710 nt, Artificial Sequence
  derived and/or modified CDS sequence (opt2) from Lassa virus__AIT17475__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucuccaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacaccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccaucuccggcugcuacauccacuucuuccgcgagcccaccgaccucaagcaguucaagcaggacgccaaguacucccacggcaucgacgucaccgaccucuuccccgcccagcccggccucaccuccgccgucaucgaggcccucccccgcaacaugguccucaccugccagggcuccgacgacaucaagcgccuccucgacucccagggccgccgcgacaucaagaucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1420 - RNA, 1710 nt, Artificial Sequence
  derived and/or modified CDS sequence (opt2) from Lassa virus__AIT17479__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgcaaggacaucaagcucaucgacaucgcccucuccaaggucgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1421 - RNA, 1710 nt, Artificial Sequence
  derived and/or modified CDS sequence (opt2) from Lassa virus__AIT17491__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucuccaugaucggcauggucggcggcgcccgcggcacccagcccggccgcgacggcgucguccgcgucugggacgucaagaaccccgaccuccucaacaaccaguucggcaccaugcccucccucacccucgccugccucaccaagcagggccaggucgaccucaacgacgucguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcgccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1422 - RNA, 1710 nt, Artificial Sequence
  derived and/or modified CDS sequence (opt2) from Lassa virus__AIT17495__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccaguccgcccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacgcccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1423 - RNA, 1710 nt, Artificial Sequence
  derived and/or modified CDS sequence (opt2) from Lassa virus__AIT17499__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaucaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcgccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacgucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1424 - RNA, 1710 nt, Artificial Sequence
  derived and/or modified CDS sequence (opt2) from Lassa virus__AIT17503__NP
auguccuccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1425 - RNA, 1710 nt, Artificial Sequence
  derived and/or modified CDS sequence (opt2) from Lassa virus__AIT17507__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaaccucaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccaucgacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccacaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggucgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1426 - RNA, 1710 nt, Artificial Sequence
  derived and/or modified CDS sequence (opt2) from Lassa virus__AIT17511__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccaucgacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1427 - RNA, 1710 nt, Artificial Sequence
  derived and/or modified CDS sequence (opt2) from Lassa virus__AIT17515__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcgccgccggcuccuccaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccgucuccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1428 - RNA, 1710 nt, Artificial Sequence
  derived and/or modified CDS sequence (opt2) from Lassa virus__AIT17519__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1429 - RNA, 1710 nt, Artificial Sequence
  derived and/or modified CDS sequence (opt2) from Lassa virus__AIT17525__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccgucgacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccacccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1430 - RNA, 1710 nt, Artificial Sequence
  derived and/or modified CDS sequence (opt2) from Lassa virus__AIT17533__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucaacaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggccggcggcacccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucucccucuccaagaucgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguucgacgccgccgucuccggcggccucaacauccccguccuccgcgccguccucccccgcgacauggucuuccgcaccuccucccccaaggucguccucuga

SEQ ID NO: 1431 - RNA, 1710 nt, Artificial Sequence
  derived and/or modified CDS sequence (opt2) from Lassa virus__AIT17539__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucauccgcaccgagcgcccccucuccuccggcgucuacaugggcaaccucuccacccagcagcucgagcagcgcaaggcccuccucuccaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcuccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuucuccgcccagcccggccucaccuccgccgucaucgaggcccucccccgcaacaugguccucaccugccagggcuccgacgacaucaagaagcuccucgacucccagggccgccgcgacaucaagcucaucgacaucucccucggcaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguucgacgccgccgucuccggcggccucaacauccccauccuccgcgccguccucccccgcgacauggucuuccgcaccuccucccccaaggucguccucuga

SEQ ID NO: 1432 - RNA, 1710 nt, Artificial Sequence
  derived and/or modified CDS sequence (opt2) from Lassa virus__AIT17541__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccguccuccgcgucggcacccucuccuccgacgaccuccucacccucgccgccgaccucgagaagcucaaguccaaggucauccgcaccgagcgcccccucuccuccggcgucuacaugggcaaccucuccucccagcagcucgaccagcgccgcgcccuccucaacaugaucggcaugaccuccgaccgccagggcgccuccaccggccgcgacggcaucguccgcgucugggacgucaagaacgccgagcuccucaacaaccaguucggcaccguccccucccucacccucgccugccucaccaagcagggccaggucgaccucaacgacgccguccaggcccucaccgaccucggccucaucuacaccgccaaguaccccaacuccuccgaccucgaccgccucucccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagcgcucccucggcauguucgucuccgacauccccggcgagcgcaaccccuacgagaacauccucuacaagaucugccucuccggcgacggcuggcccuacaucgccucccgcaccuccaucaccggccgcgccugggagaacaccaucgucgaccucgaguccgacuccaagccccagaagcccggcaacuccggcuccaaccgcucccuccaguccgccggcuuccccgccggccucaccuacucccagcucaugacccucaaggacuccaugcuccagcucgaccccaacgccaagaccuggauggacaucgagggccgccccgacgaccccgucgagaucgcccucuaccagcccuccuccggcugcuacauccacuucuuccgcgagcccaccgaccucaagcaguucaagcaggacgccaaguacucccacggcaucgacgucggcgaccucuucgccgcccagcccggccucaccuccgccgucaucgaggcccucccccgcaacauggucaucaccugccagggcuccgaggacaucaagaagcuccucgagucccagggccgcaaggacaucaagcucgucgacaucuccauguccaagcccgacucccgcaaguucgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucgucggcggccucgacgcccgcauccuccgcgccguccucccccgcgacauggucuuccgcaccuccacccccaaggucguccucuga

SEQ ID NO: 1433 - RNA, 1710 nt, Artificial Sequence
  derived and/or modified CDS sequence (opt2) from Lassa virus__AIT17545__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaucgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucgacauccccguccuccgcgccguccucccccgcgacauggucuuccgcaccuccucccccaaggucguccucuga

SEQ ID NO: 1434 - RNA, 1710 nt, Artificial Sequence
  derived and/or modified CDS sequence (opt2) from Lassa virus__AIT17549__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgucguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgucggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1435 - RNA, 1710 nt, Artificial Sequence
  derived and/or modified CDS sequence (opt2) from Lassa virus__AIT17553__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaagaugggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1436 - RNA, 1710 nt, Artificial Sequence
  derived and/or modified CDS sequence (opt2) from Lassa virus__AIT17561__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccaucgacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgucggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagcgccgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1437 - RNA, 1710 nt, Artificial Sequence
  derived and/or modified CDS sequence (opt2) from Lassa virus__AIT17565__NP
auguccgccuccaaggagaucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacgcccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1438 - RNA, 1710 nt, Artificial Sequence
  derived and/or modified CDS sequence (opt2) from Lassa virus__AIT17569__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguuccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccaccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaaccuccccguccuccgcgccguccucccccgcgacauggucuuccgcaccuccucccccaaggucguccucuga

SEQ ID NO: 1439 - RNA, 1710 nt, Artificial Sequence
  derived and/or modified CDS sequence (opt2) from Lassa virus__AIT17573__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacaucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1440 - RNA, 1710 nt, Artificial Sequence
  derived and/or modified CDS sequence (opt2) from Lassa virus__AIT17577__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgccggccgcgccugggagaacaccaccgucgaccucgaguccgacggcaagccccagaaggucggcgccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugccgcgaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1441 - RNA, 1710 nt, Artificial Sequence
  derived and/or modified CDS sequence (opt2) from Lassa virus__AIT17581__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcacccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgucguccucgcccucaccgaccucggccucaucuacaccgccaaguaccccaacuccuccgaccucgaccgccucucccagucccaccccauccucuccauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1442 - RNA, 1710 nt, Artificial Sequence
  derived and/or modified CDS sequence (opt2) from Lassa virus__AIT17589__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccaccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1443 - RNA, 1710 nt, Artificial Sequence
  derived and/or modified CDS sequence (opt2) from Lassa virus__AIT17593__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccucccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcgccgccggcuccaccaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggucgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1444 - RNA, 1710 nt, Artificial Sequence
  derived and/or modified CDS sequence (opt2) from Lassa virus__AIT17605__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggccggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1445 - RNA, 1710 nt, Artificial Sequence
  derived and/or modified CDS sequence (opt2) from Lassa virus__AIT17609__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggccggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcgccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1446 - RNA, 1710 nt, Artificial Sequence
  derived and/or modified CDS sequence (opt2) from Lassa virus__AIT17613__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaagaccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1447 - RNA, 1710 nt, Artificial Sequence
  derived and/or modified CDS sequence (opt2) from Lassa virus__AIT17617__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1448 - RNA, 1710 nt, Artificial Sequence
  derived and/or modified CDS sequence (opt2) from Lassa virus__AIT17621__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucaccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaucgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1449 - RNA, 1710 nt, Artificial Sequence
  derived and/or modified CDS sequence (opt2) from Lassa virus__AIT17625__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccgucgacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1450 - RNA, 1710 nt, Artificial Sequence
  derived and/or modified CDS sequence (opt2) from Lassa virus__AIT17627__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccucccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcuccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1451 - RNA, 1710 nt, Artificial Sequence
  derived and/or modified CDS sequence (opt2) from Lassa virus__AIT17631__NP
auguccgccuccaaggagaucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacgcccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1452 - RNA, 1710 nt, Artificial Sequence
  derived and/or modified CDS sequence (opt2) from Lassa virus__AIT17635__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacaacgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucaacacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1453 - RNA, 1710 nt, Artificial Sequence
  derived and/or modified CDS sequence (opt2) from Lassa virus__AIT17639__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaucaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcuccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1454 - RNA, 1710 nt, Artificial Sequence
  derived and/or modified CDS sequence (opt2) from Lassa virus__AIT17643__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1455 - RNA, 1710 nt, Artificial Sequence
  derived and/or modified CDS sequence (opt2) from Lassa virus__AIT17651__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgucguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1456 - RNA, 1710 nt, Artificial Sequence
  derived and/or modified CDS sequence (opt2) from Lassa virus__AIT17655__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagaagccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguuccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccaccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1457 - RNA, 1710 nt, Artificial Sequence
  derived and/or modified CDS sequence (opt2) from Lassa virus__AIT17659__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucuccaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucaacaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1458 - RNA, 1710 nt, Artificial Sequence
  derived and/or modified CDS sequence (opt2) from Lassa virus__AIT17663__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagaagcuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1459 - RNA, 1710 nt, Artificial Sequence
  derived and/or modified CDS sequence (opt2) from Lassa virus__AIT17667__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccaucgacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccaccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuuccccgcccagcccggccucaccuccgccgucaucgaggcccucccccgcaacaugguccucaccugccagggcuccgaggacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1460 - RNA, 1710 nt, Artificial Sequence
  derived and/or modified CDS sequence (opt2) from Lassa virus__AIT17671__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgucguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1461 - RNA, 1710 nt, Artificial Sequence
  derived and/or modified CDS sequence (opt2) from Lassa virus__AIT17675__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaucgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1462 - RNA, 1710 nt, Artificial Sequence
  derived and/or modified CDS sequence (opt2) from Lassa virus__AIT17679__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccaguccacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1463 - RNA, 1710 nt, Artificial Sequence
  derived and/or modified CDS sequence (opt2) from Lassa virus__AIT17683__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1464 - RNA, 1710 nt, Artificial Sequence
  derived and/or modified CDS sequence (opt2) from Lassa virus__AIT17687__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1465 - RNA, 1710 nt, Artificial Sequence
  derived and/or modified CDS sequence (opt2) from Lassa virus__AIT17695__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaaccucaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgucguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccacaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccacaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1466 - RNA, 1710 nt, Artificial Sequence
  derived and/or modified CDS sequence (opt2) from Lassa virus__AIT17705__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaaccucaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccacaaggucggcaccgccggcuccaaccgcucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1467 - RNA, 1710 nt, Artificial Sequence
  derived and/or modified CDS sequence (opt2) from Lassa virus__AIT17711__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaaccucaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuucaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccacaaggucggcaccgccggcuccuccaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1468 - RNA, 1710 nt, Artificial Sequence
  derived and/or modified CDS sequence (opt2) from Lassa virus__AIT17713__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaucaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucaacaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1469 - RNA, 1710 nt, Artificial Sequence
  derived and/or modified CDS sequence (opt2) from Lassa virus__AIT17719__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucuccggcgcccagggcacccagcccggccgcgacggcgucguccgcgucugggacgucaagaaccccgagcuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucucccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1470 - RNA, 1710 nt, Artificial Sequence
  derived and/or modified CDS sequence (opt2) from Lassa virus__AIT17725__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccgcccagcagcucgagcagcgccgcgcccuccucaacaugaucggcauggucggcggcgcccagggcacccagcucggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgaggacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1471 - RNA, 1710 nt, Artificial Sequence
  derived and/or modified CDS sequence (opt2) from Lassa virus__AIT17729__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcacccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgcaaguucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1472 - RNA, 1710 nt, Artificial Sequence
  derived and/or modified CDS sequence (opt2) from Lassa virus__AIT17733__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1473 - RNA, 1710 nt, Artificial Sequence
  derived and/or modified CDS sequence (opt2) from Lassa virus__AIT17745__NP
auguccgccuccaaggagaucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacgcccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggucgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1474 - RNA, 1710 nt, Artificial Sequence
  derived and/or modified CDS sequence (opt2) from Lassa virus__AIT17753__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccaccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1475 - RNA, 1710 nt, Artificial Sequence
  derived and/or modified CDS sequence (opt2) from Lassa virus__AIT17763__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccgucgacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacgagaagccccagaaggucggcgccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1476 - RNA, 1710 nt, Artificial Sequence
  derived and/or modified CDS sequence (opt2) from Lassa virus__AIT17771__NP
auguccgccuccaaggaggucaaguccuuccucuggacccagucccuccgccgcgagcucuccggcuacugcuccuccaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagacccagaaggucuccaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1477 - RNA, 1710 nt, Artificial Sequence
  derived and/or modified CDS sequence (opt2) from Lassa virus__AIT17779__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaagaccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1478 - RNA, 1710 nt, Artificial Sequence
  derived and/or modified CDS sequence (opt2) from Lassa virus__AIT17783__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacuccgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgucguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccgucuccggcugcuacauccacuucuuccgcgagcccaccgaccucaagcaguucaagcaggacgccaaguacucccacggcaucgacgucgccgaccucuuccccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggccgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1479 - RNA, 1710 nt, Artificial Sequence
  derived and/or modified CDS sequence (opt2) from Lassa virus__AIT17787__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccauccuccgcgucggcacccucaccuccgacgaccuccucacccucgccgccgaccucgagaagcucaaguccaaggucauccgcaccgagcgcccccucuccuccggcgucuacaugggcaaccucuccacccagcagcucgagcagcgccgcgcccuccucaacaugaucggcauggucggcggcgcccagggcacccagcccggccgcgacggcgucguccgcgucugggacgucaagaaccccgaccuccucaacaaccaguucggcaccaugcccucccucacccucgccugccucaccaagcagggccaggucgaccucaacgacgccguccucgcccucaccgaccucggccucaucuacaccgccaaguaccccaacuccuccgaccucgaccgccucucccagucccaccccauccucaacauggucgacaccaagaaguccucccucaacaucuccggcuacaacuucucccucggcgccgccgucaaggccggcgccugcaugcucgacggcggcaacaugcucgagaccaucaaggucaccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccaccgucgaccucgaguccgacggcaagccccagaaggucggcaccgccggcuccaacaagucccuccaguccgccggcuuccccaccggccucaccuacucccagcucaugacccucaaggacuccaugaugcagcucgaccccuccgccaagaccuggaucgacaucgagggccgccccgaggaccccgucgagaucgcccucuaccagcccauguccggcugcuacauccacuucuuccgcgagcccaccgaccucaagcaguucaagcaggacgccaaguacucccacggcaucgacgucaccgaccucuucuccgcccagcccggccucaccuccgccgucaucgaggcccucccccgcaacaugguccucaccugccagggcuccgacgacaucaagcgccuccucgacucccagggccgccgcgacaucaagcucaucgacaucgcccucuccaaggucgacucccgccgcuucgagaacgccgucugggaccagugcaaggaccucugccacaugcacaccggcgucgucgucgagaagaagaagcgcggcggcaaggaggagaucaccccccacugcgcccucauggacugcaucauguacgacgccgccgucuccggcggccucaacauccccguccuccgcgccguccucccccgcgacauggucuuccgcaccuccucccccaaggucguccucuga

SEQ ID NO: 1480 - RNA, 1710 nt, Artificial Sequence
  derived and/or modified CDS sequence (opt2) from Lassa virus__AIT17803__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucuccaugaucggcauguccggcggcucccaggaggcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccgucgacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1481 - RNA, 1710 nt, Artificial Sequence
  derived and/or modified CDS sequence (opt2) from Lassa virus__AIT17811__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgccuucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaaccucgucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacgccuccguccuccgcgccguccucccccgcgacauggucuuccgcaccuccaccccccgcgucguccucuga

SEQ ID NO: 1482 - RNA, 1710 nt, Artificial Sequence
  derived and/or modified CDS sequence (opt2) from Lassa virus__AIT17815__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucgacaugaucggcauguccggcuccaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacgcccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1483 - RNA, 1710 nt, Artificial Sequence
  derived and/or modified CDS sequence (opt2) from Lassa virus__AIT17821__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucuccaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccgucgacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaagaccggcuccaacaacuccaacaagucccuccaguccgccggcuucaccgccggccucaccuacucccagcucaugacccucaaggacgccaugcuccagcucgaccccaacgccaagaccuggauggacaucgagggccgccccgaggaccccgucgaggucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1484 - RNA, 1710 nt, Artificial Sequence
  derived and/or modified CDS sequence (opt2) from Lassa virus__AIT17837__NP
auguccaacuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacgccgaccucaagcgccuccgcgaccucaaccaggccgucaacaaccucgucgagcucaaguccacccagcagaagaacguccuccgcgucggcacccucuccuccgacgaccucaucacccucgccgccgaccucgagaagcucaaguccaaggucauccgcaccgagcgcccccucuccuccggcgucuacaugggcaaccucuccucccagcagcucgaccagcgccgcgcccuccucuccaugaucggcauguccggcggcccccagggcaaccgcaccggcggcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgacaugcucacccagucccaccccauccucggcauggucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagcgcucccucggcauguucaucuccgacacccccggcgagcgcaaccccuacgagaacauccucuacaagaucugccucuccggcgagggcuggcccuacaucgccucccgcaccuccaucaccggccgcgccugggagaacacccucgucgaccucgaguccgacaacaagccccccaagcucaacuccgccggcuccaacaagucccuccaggccgccggccucaacgccggccucaccuacucccagcucaugacccucaaggacugcaugcuccagcucgaccccuccuccaagaccuggaucgacaucgagggccgccccgaggaccccgucgagaucgcccucuuccagcccuccuccggcugcuacauccacuucuuccgcgagcccaccgaccucaagcaguucaagcaggacgccaaguacucccacggcaucgacgucaccgaccucuucuccacccagcccggccucaccuccgccgucaucgaggcccucccccgcaacaugguccucaccugccagggcuccgacgacaucaagaagcuccucgagucccagggccgccgcgacaucaagcucaucgacaucucccucuccaaggccgacucccgcaaguucgagaacgccgucugggaccaguacaaggaccucugccacaugcacaccggcgucgucgucgagaagaagaagcgcggcggcaaggaggagaucaccccccacugcgcccuccucgacugcaucauguucgacgccgccaccaccggcucccucaacaucaccacccuccgcgccguccucccccgcgacauggucuuccgcaccuccacccccaaggucguccucuga

SEQ ID NO: 1485 - RNA, 1710 nt, Artificial Sequence
  derived and/or modified CDS sequence (opt2) from Lassa virus__AIT17841__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacgcccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1486 - RNA, 1710 nt, Artificial Sequence
  derived and/or modified CDS sequence (opt2) from Lassa virus__AIT17845__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcuccaaccagggcgcccagaccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacgcccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccggcuccaacggcuccaacaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccgcccagcccggccucaccuccgccgucaucgacgcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcaucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1487 - RNA, 1710 nt, Artificial Sequence
  derived and/or modified CDS sequence (opt2) from Lassa virus__ANH09723__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucacccgcaccgagcgcccccucaccgccggcgucuacaugggcaaccucuccucccagcagcucgaccagcgccgcgcccuccucaacaugaucggcauguccggcggcaaccagggcgcccgcaccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaacaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcggcaagccccagaaggccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccaucuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcucuucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1488 - RNA, 1710 nt, Artificial Sequence
  derived and/or modified CDS sequence (opt2) from Lassa virus__ANH09725__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucauccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaacaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcggcaagccccagaaggccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccaucuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1489 - RNA, 1710 nt, Artificial Sequence
  derived and/or modified CDS sequence (opt2) from Lassa virus__ANH09729__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcaccggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaacaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcggcaagccccagcgcgccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgcccucuaccagcccaccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1490 - RNA, 1710 nt, Artificial Sequence
  derived and/or modified CDS sequence (opt2) from Lassa virus__ANH09731__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucacccgcaccgagcgcccccucuccgccggcgucuacaugggcaaccucuccucccagcagcucgaccagcgccgcgcccuccucaacaugaucggcaugaccggcggcaaccagggcgcccgcaccggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaacaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcggcaagccccagcgcgccggcuccaacaacuccaacaagucccuccaguccgccggccucgccgccggccucaccuacucccagcucaugacccucaaggacgccaugcuccagcucgaccccaacgccaagaccuggauggacaucgagggccgccccgaggaccccgucgagaucgcccucuaccagcccaccuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1491 - RNA, 1710 nt, Artificial Sequence
  derived and/or modified CDS sequence (opt2) from Lassa virus__ANH09733__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacaacgaccucaagcgccuccgcgaccucaaccaggccgucaacaaccucgucgagcucaaguccacccagcagaaguccguccuccgcgucggcacccucaccuccgacgaccuccucacccucgccgccgaccucgagaagcucaaguccaaggucacccgcaccgagcgcccccucuccgccggcgucuacaugggcaaccucuccucccagcagcucgaccagcgccgcgcccuccucaacaugaucggcauguccggcggcaaccagggcgcccgcaccggccgcgacggcgucguccgcgucugggacgucaagaacgccgaccuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaacaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccggcggcaagccccagcgcgccggcuccaacaacuccaacaagucccuccaguccgccggcuucgccgccggccucaccuacucccagcucaugacccucaaggacgccaugcuccagcucgaccccaacgccaagaccuggauggacaucgagggccgccccgaggaccccgucgagaucgccuucuaccagcccaucuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagaagggcggcaaggaggagaucaccccccacugcgcccucauggacugcaucauguucgacgccgccgucuccggcggccucaacacccucguccuccgcgccguccucccccgcgacauggucuuccgcaccuccacccccaaggucguccucuga

SEQ ID NO: 1492 - RNA, 1710 nt, Artificial Sequence
  derived and/or modified CDS sequence (opt2) from Lassa virus__ANH09735__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacauccagcgccucaugcgcaaggagcgccgcgacgacuccgaccucaagcgccuccgcgaccucaaccaggccgucaacaaccucgucgagcucaaguccacccagcagaaguccguccuccgcgucggcacccucuccuccgacgaccuccucacccucgccgccgaccucgagaagcucaaguccaaggucauccgcaccgagcgcccccucuccuccggcgucuacaugggcaaccucuccacccagcagcucgaccagcgccgcgcccuccucaacaugaucggcaugaccaacggcggccagggcgccaacgccggccgcgacggcaucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucucccagaaccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacgucgccucccgcaccuccaucaucggccgcgccugggagaacaccgucgucgaccucgaguccgacuccaagccccagcgccccggcuccaaggaguccaaccgcucccuccagaccgccggcuuccccgccggccucaccuacucccagcucaugacccucaaggacuccaugcuccagcucgaccccaacgccaagaccuggauggacaucgagggccgccccgacgaccccgucgagaucgcccucuaccagcccuccuccggcugcuacauccacuucuuccgcgagcccaccgaccucaagcaguucaagcaggacgccaaguacucccacggcaucgacaucggcgaccucuucgccgcccagcccggccucaccuccgccgucaucgaggcccucccccgcaacauggucaucaccugccagggcuccgaggacaucaagcgccuccucgagucccagggccgcaaggacauccgccucgucgacaucucccucuccaaggccgacucccgcaaguucgagaacgccgucugggaccaguucaaggaccucugcaacaugcacaccggcgucgucgucgagaagaagaagaagggcggcaaggaggagaucaccccccacugcgcccucauggacugcaucauguucgacgccgccgucaugggcggccucgacgccaagguccuccgcgccguccuccccaaggacauggucuuccgcaccuccaccccccgcgucguccucuga

SEQ ID NO: 1493 - RNA, 1710 nt, Artificial Sequence
  derived and/or modified CDS sequence (opt2) from Lassa virus__ANH09737__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacauccagcgccucaugcgcaaggagcgccgcgacgacuccgaccucaagcgccuccgcgaccucaaccaggccgucaacaaccucgucgagcucaaguccacccagcagaaguccguccuccgcgucggcacccucuccuccgacgaccuccucacccucgccgccgaccucgagaagcucaaguccaaggucauccgcaccgagcgcccccucuccuccggcgucuacaugggcaaccucuccacccagcagcucgaccagcgccgcgcccuccucaacaugaucggcaugaccaacggcggccagggcgccaacgccggccgcgacggcaucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucucccagaaccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacgucgccucccgcaccuccaucaucggccgcgccugggagaacaccgucgucgaccucgaguccgacuccaagccccagcgccccggcuccaaggaguccaaccgcucccuccagaccgccggcuuccccgccggccucaccuacucccagcucaugacccucaaggacuccaugcuccagcucgaccccaacgccaagaccuggauggacaucgagggccgccccgacgaccccgucgagaucgcccucuaccagcccuccuccggcugcuacauccacuucuuccgcgagcccaccgaccucaagcaguucaagcaggacgccaaguacucccacggcaucgacaugggcgaccucuucgccgcccagcccggccucaccuccgccgucaucgaggcccucccccgcaacauggucaucaccugccagggcuccgaggacaucaagcgccuccucgagucccagggccgccgcgacauccgccucgucgacaucucccucuccaaggccgacucccgcaaguucgagaacgccgucugggaccaguucaaggaccucugcaacaugcacaccggcgucgucgucgagaagaagaagaagggcggcaaggaggagaucaccccccacugcgcccucauggacugcaucauguucgacgccgccgucaugggcggccucgacgccaagguccuccgcgccguccuccccaaggacauggucuuccgcaccuccaccccccgcgucguccucuga

SEQ ID NO: 1494 - RNA, 1710 nt, Artificial Sequence
  derived and/or modified CDS sequence (opt2) from Lassa virus__ANH09739__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacauccagcgccucaugcgcaaggagcgccgcgacgacuccgaccucaagcgccuccgcgaccucaaccaggccgucaacaaccucgucgagcucaaguccacccagcagaaguccguccuccgcgucggcacccucuccuccgacgaccuccucacccucgccgccgaccucgagaagcucaaguccaaggucauccgcaccgagcgcccccucuccuccggcgucuacaugggcaaccucuccacccagcagcucgaccagcgccgcgcccuccucaacaugaucggcaugaccuccggcggccagggcgccaacgccggccgcgacggcaucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucucccagaaccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagcgcucccucggcauguucgucuccgacacccccggcgagcgcaaccccuacgagaacauccucuacaagaucugccucuccggcgacggcuggcccuacgucgccucccgcaccuccaucaucggccgcgccugggagaacaccgucgucgaccucgaguccgacuccaagccccagcgccccggcuccaaggaguccaaccgcucccuccagaccgccggcuuccccgccggccucaccuacucccagcucaugacccucaaggacuccaugcuccagcucgaccccaacgccaagaccuggauggacaucgagggccgccccgacgaccccgucgagaucgcccucuaccagcccuccuccggcugcuacauccacuucuuccgcgagcccaccgaccucaagcaguucaagcaggacgccaaguacucccacggcaucgacaucggcgaccucuucgccgcccagcccggccucaccuccgccgucaucgaggcccucccccgcaacauggucaucaccugccagggcuccgaggacaucaagcgccuccucgagucccagggccgccgcgacauccgccucgucgacaucucccucuccaaggccgacucccgcaaguucgagaacgccgucugggaccaguucaaggaccucugcaacaugcacaccggcgucgucgucgagaagaagaagaagggcggcaaggaggagaucaccccccacugcgcccucauggacugcaucauguucgacgccgccgucaugggcggccucgacgccaagguccuccgcgccguccuccccaaggacauggucuuccgcaccuccaccccccgcgucguccucuga

SEQ ID NO: 1495 - RNA, 1710 nt, Artificial Sequence
  derived and/or modified CDS sequence (opt2) from Lassa virus__ANH09741__NP
auguccaacuccaaggaggucaaguccuuccucuggacccagucccuccgccgcgagcucuccggcuacugcaccaacaucaagcuccaggucgucaaggacgcccaggcccuccuccacggccucgacuucuccgaggucuccaacguccagcgccucaugcgcaagcagaagcgcgacgacaacgaccucaagcgccuccgcgaccucaaccaggccgucaacaaccucgucgagcucaaguccguccagcagaaguccguccucaaggucggcacccucaacuccgacgaccuccucacccucgccgccgaccucgagaagcucaaguccaaggucguccgcaccgagcgcccccucuccuccggcgucuacaugggcaaccucuccucccagcagcucgaccagcgccgcgcccuccucaacaugaucggcauggccggcggcucccagggcaaccagcccucccgcgacggcgucguccgcgucugggacgucaagaacgccgaccuccucaacaaccaguucggcaccaugcccucccucacccucgccugccucaccaagcagggccaggucgaccucaacgacgucguccucgcccucaccgaccucggccucaucuacaccgccaaguaccccaacuccuccgaccucgaccgccucucccagaaccaccccguccucaacaugaucgacgucaacaaguccucccucaacaucuccggcuacaacuucucccucggcgccgccgucaaggccggcgccugcaugcucgacggcggcaacaugcucgagaccaucaagaucuccccccagaccgucgacggcauccucaaguccauccucaaggucaagcgcgcccucggcauguucgucuccgacacccccggcgagcgcaaccccuacgagaacauccucuacaaggucugccucuccggcaacggcuggcccuacaucgccucccgcaccuccaucgucggccgcgccugggagaacaccgucgucgaccucgaguccaacaagaaccagcccaaggucggcaacaacggcuccaacaagaugcuccaguccuccggcuucgccaccggccucaccuacucccagcucaugacccuccgcgacuccaugcuccagcucgaccccaccgccaagaccuggaucgacaucgagggccgccccgaggaccccgucgagcucgcccucuuccagcccuccuccggcugcuacauccacuucuuccgcgagcccaccgaccucaagcaguucaagcaggacgccaaguacucccacggcaucgacgucaacgaccucuucuccgcccagcccggccucaccuccgccguccucgaggcccucccccgcaacaugguccucaccugccagggcuccgacgacauccgcaagcuccucgacucccaggaccgcaaggacaucaagcucaucgacaucucccucuccaaggccgacgcccgcaaguucgagaacgacgucugggaccaguucaaggaccucugccacaugcacaccggcaucgucgucgagaagaagaagaagggcggcaagcaggagaugaccccccacugcgcccuccucgacugcaucauguucgacgccgccgucuccggcggccucaacguccccacccuccgcgccguccuccccaccgacauggucuuccgcaccaucaccaccaaggucguccucuga

SEQ ID NO: 1496 - RNA, 1713 nt, Artificial Sequence
  derived and/or modified CDS sequence (opt2) from Lassa virus__CAA36646__NP
auguccgccuccaaggagguccgcuccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccacccagcagaaguccguccuccgcgucggcacccucuccuccgacgaccuccucauccucgccgccgaccucgagaagcucaaguccaaggucacccgcaccgagcgcccccucuccuccggcgucuacaugggcaaccucuccucccagcagcucgaccagcgccgcgcccuccucaacaugaucggcaugaccggcgucuccggcggcggcaagggcgccuccgacggcaucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucucccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaagucccucggcauguucgucuccgacacccccggcgagcgcaaccccuacgagaacauccucuacaagaucugccucuccggcgacggcuggcccuacaucgccucccgcaccuccaucgucggccgcgccugggagaacaccgucgucgaccucgagcaggacaacaagccccagaagaucggcaacggcggcuccaacaagucccuccaguccgccggcuucgccgccggccucaccuacucccagcucaugacccucaaggacuucaagugcuucaaccucauccccaacgccaagaccuggauggacaucgagggccgccccgaggaccccgucgagaucgcccucuaccagcccuccuccggcugcuacguccacuucuuccgcgagcccaccgaccucaagcaguucaagcaggacgccaaguacucccacggcaucgacgucaccgaccucuucgccgcccagcccggccucaccuccgccgucaucgaggcccucccccgcaacauggucaucaccugccagggcuccgaggacauccgcaagcuccucgagucccagggccgccgcgacaucaagcucaucgacaucacccucuccaaggccgacucccgcaaguucgagaacgccgucugggaccaguucaaggaccucugccacaugcacaccggcgucgucgucgagaagaagaagcgcggcggcaaggaggagaucaccccccacugcgcccucauggacugcaucauguucgacgccgccgucuccggcggccucgacgccaagguccuccgcgucguccucccccgcgacauggucuuccgcaccuccacccccaaggucguccucuga

SEQ ID NO: 1497 - RNA, 1710 nt, Artificial Sequence
  derived and/or modified CDS sequence (opt2) from Lassa virus__CCA30315__NP
auguccgccuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagcgccgcgacgacuccgaccucaagcgccuccgcgaccucaaccaggccgucaacaaccucgucgagcucaaguccacccagcagaaguccguccuccgcgucggcacccucuccuccgacgaccuccucacccucgccgccgaccucgagaagcucaaguccaaggucacccgcaccgagcgcccccucuccuccggcgucuacaugggcaaccucuccucccagcagcucgaccagcgccgcgcccuccucaaccucaucggcaugaccaacggcucccagggcucccaggccggccgcgacggcgucguccgcgucugggacgucaagaacgccgagcuccucaacaaccaguucggcaccaugcccucccucacccucgccugccucaccaagcagggccaggucgaccucaacgacgucguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccaguccauggacggcauccucaaguccauccucaaggucaagcgcgcccucggcauguucgucuccgacacccccggcgagcgcaaccccuacgagaacauccucuacaagaucugccucuccggcgacggcuggcccuacaucgccucccgcaccuccaucgucggccgcgccugggagaacaccgucgucgaccucgagaccgacggcaagccccagaagaucggcuccggcaacuccaacaagucccuccaguccgccggcuucuccgccggccucaccuacucccagcucaugacccucaaggacgccaugcuccagcucgaccccaacgccaagaccuggauggacaucgagggccgccccgaggaccccgucgaggucgcccucuaccagcccaucuccggcugcuacauccacuucuuccgcgagcccaccgaccucaagcaguucaagcaggacgccaaguacucccacggcaucgacaucgccgaccucuucgccgcccagcccggccucaccuccgccgucaucgaggcccucccccgcaacauggucaucaccugccagggcuccgaggacaucaagaagcuccucgagucccagggccgcaaggacaucaagcucaucgacaucgcccucuccaagaucgacucccgcaaguucgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacacccucguccuccgcgccguccucccccgcgacauggucuuccgcaccuccaccccccgcgucguccucuga

SEQ ID NO: 1498 - RNA, 1710 nt, Artificial Sequence
  derived and/or modified CDS sequence (opt2) from Lassa virus__JX985061__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcuccgcuccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucuccaaccaguucggcaccauccccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgaccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1499 - RNA, 1710 nt, Artificial Sequence
  derived and/or modified CDS sequence (opt2) from Lassa virus__NP_694869__NP
auguccgccuccaaggagaucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaaggagcgccgcgacgacaacgaccucaagcgccuccgcgaccucaaccaggccgucaacaaccucgucgagcucaaguccacccagcagaaguccauccuccgcgucggcacccucaccuccgacgaccuccucauccucgccgccgaccucgagaagcucaaguccaaggucauccgcaccgagcgcccccucuccgccggcgucuacaugggcaaccucuccucccagcagcucgaccagcgccgcgcccuccucaacaugaucggcauguccggcggcaaccagggcgcccgcgccggccgcgacggcgucguccgcgucugggacgucaagaacgccgagcuccucaacaaccaguucggcaccaugcccucccucacccucgccugccucaccaagcagggccaggucgaccucaacgacgccguccaggcccucaccgaccucggccucaucuacaccgccaaguaccccaacaccuccgaccucgaccgccucacccagucccaccccauccucaacaugaucgacaccaagaaguccucccucaacaucuccggcuacaacuucucccucggcgccgccgucaaggccggcgccugcaugcucgacggcggcaacaugcucgagaccaucaaggucuccccccagaccauggacggcauccucaaguccauccucaaggucaagaaggcccucggcauguucaucuccgacacccccggcgagcgcaaccccuacgagaacauccucuacaagaucugccucuccggcgacggcuggcccuacaucgccucccgcaccuccaucaccggccgcgccugggagaacaccgucgucgaccucgaguccgacggcaagccccagaaggccgacuccaacaacuccuccaagucccuccaguccgccggcuucaccgccggccucaccuacucccagcucaugacccucaaggacgccaugcuccagcucgaccccaacgccaagaccuggauggacaucgagggccgccccgaggaccccgucgagaucgcccucuaccagcccuccuccggcugcuacauccacuucuuccgcgagcccaccgaccucaagcaguucaagcaggacgccaaguacucccacggcaucgacgucaccgaccucuucgccacccagcccggccucaccuccgccgucaucgacgcccucccccgcaacauggucaucaccugccagggcuccgacgacauccgcaagcuccucgagucccagggccgcaaggacaucaagcucaucgacaucgcccucuccaagaccgacucccgcaaguacgagaacgccgucugggaccaguacaaggaccucugccacaugcacaccggcgucgucgucgagaagaagaagcgcggcggcaaggaggagaucaccccccacugcgcccucauggacugcaucauguucgacgccgccgucuccggcggccucaacaccuccguccuccgcgccguccucccccgcgacauggucuuccgcaccuccaccccccgcgucguccucuga

SEQ ID NO: 1500 - RNA, 1710 nt, Artificial Sequence
  derived and/or modified CDS sequence (opt2) from Lassa virus__SCA79106__NP
auguccaacuccaaggaggucaaguccuuccucuggacccagucccuccgccgcgagcucuccggcuacugcuccaacaucaagcuccaggucgucaaggacgcccaggcccuccuccacggccucgacuucuccgaggucuccaacguccagcgccucaugcgcaagcagaagcgcgacgacggcgaccucaagcgccuccgcgaccucaaccaggccgucaacaaccucgucgagcucaaguccguccagcagaaguccauccuccgcgucggcacccucaccuccgacgaccuccucacccucgccgccgaccucgagaagcucaaguccaaggucacccgcaccgagcgcccccucuccuccggcgucuacaugggcaaccucuccucccagcagcucgaccagcgccgcgcccuccucuccaugaucggcauguccggcggcaaccagaacucccagcccaagggcgacggcgucguccgcgucugggacgucaagaacgccgaccuccucaacaaccaguucggcaccaugcccucccucacccucgccugccucaccaagcagggccaggucgaccucaacgacgccguccaggcccucaccgaccucggccucaucuacaccgccaaguaccccaacuccuccgaccucgaccgccucucccagucccaccccauccucaacaugaucgacaccaagaaguccucccucaacaucuccggcuacaacuucucccucggcgccgccaucaagaccggcgccugcaugcucgacggcggcaacaugcucgagaccaucaaggucaccccccagaccauggacggcauccucaaguccauccucaaggucaagcgcucccucggcauguucaucuccgacacccccggcgagcgcaaccccuacgagaacauccucuacaagaucugccucuccggcgacggcuggcccuacaucgccucccgcaccgccaucaucggccgcgccugggagaacaccgucgucgaccucgaguccgacuccaagccccagaagaucggcuccaacggcuccaacaagucccuccaguccgccggcuucgcccccggccucaccuacucccagcucaugacccucaaggacuccaugcuccagcucgaccccaacgccaagaccuggaucgacaucgagggccgccccgaggaccccgucgaggucgcccucuuccagcccaucuccggcugcuacauccacuucuuccgcgagcccaccgaccucaagcaguucaagcaggacgccaaguacucccacggcaucgacgucaccgaccucuucgccgcccagcccggccucaccuccgccgucaucgaggcccucccccgcaacaugguccucaccugccagggcuccgacgacaucaagaagcuccucgacucccagggccgccgcgacaucaagcucaucgacgucucccucaacaagaucgacucccgcaaguucgagaacgccgucugggaccaguacaaggaccucugccacaugcacaccggcgucgucgucgagaagaagaagaagggcggcaaggaggagaucaccccccacugcgcccuccucgacugcaucauguucgacgccgccgucuccggcggccucaacgccaccguccuccgcgccguccucccccgcgacauggucuuccgcaccuccucccccaaggucguccucuga

SEQ ID NO: 1501 - RNA, 1473 nt, Artificial Sequence
  derived and/or modified CDS sequence (opt3) from Lassa virus__AAF86703__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugaucuccuuucuacuccuguguggcagaucuugcucagugacuuauaaaggggucuacgaacuucagacgcuggaguugaacauggccaaucucaacaugaccaugccucugaguuguacaaagaauaacagccaucacuauauaauggugggaaaugaaacuggccuggagcucaccuuaacaaacaccuccaucauuaaucauaaauucugcaaccugucugacgcgcacaagaaaaaucuuuacgaucaugcuuugaugucgaucauuucaacuuuucaccugagcaucccaaacuucaaucaguaugaggccaugaguugugacuuuaacggugggaagauauccguucaguacaaucuaucucacagcuucgcaguggaugccgcuaaccauugcggaacaauugcaaacggcguccuccaaaccuuuaugaggauggccuggggcggguccuauaucgcucuggacucaggaaaggguaauugggauuguauuaugacgaguuaccaguaccuuaucauccagaacacuaccugggaagaccacugccaguucagccggccgucucccauuggcuaucugggguugcucucccaacgcacacgagauauauacaucucacguagacuguuaggaacuuuuaccuggacacugagcgacagugagggcaaugaagccccugguggguauugucucaccagguggaugcuuauugaggcggagcugaaaugcuucggaaacacggcaguggccaaguguaaugaaaaacaugaugaggaauuuugcgacauguugcggcuauucgauuucaacaagcaggcuaucaaacgccugaagacugaggcccagaugucuauacagcucauuaauaaggcaguaaacgcucugaucaaugaccaacuuaucaugaaaaaccaccugagagauauuaugggcaucccauacugcaauuauuccagguacugguauuugaaccacacaguuaccggcaagacuagccucccccgguguuggcuggugucgaaugggucuuacuuaaacgaaacacauuuuuccgacgacauugagcagcaggccgauaauaugauaaccgagaugcugcaaaaagaauacauggaccgccagggaaagacgccucuaggucucgucgaucuguucguguuuucaaccaguuucuaucuuaucagcaucuuuuugcaccuggugaaaauuccaacacaucgacacaucgucggcaagcccugcccuaaaccacauagacucaaccacauggggauuuguuccugcggacuguacaagcacccgggcguucccgugaaguggaaaagguga

SEQ ID NO: 1502 - RNA, 1476 nt, Artificial Sequence
  derived and/or modified CDS sequence (opt3) from Lassa virus__AAG41802__GPC
augggccagaucgugaccuucuuucaagaggucccccacguuauugaagaggugaugaacauaguacugaucgcccucagcauucuugcugugcugaagggguuguacaauaucgcaacaugcggauuaauuggucugaucacuuuccuacuccuguguggcagauccugcagcucaaaccuuuauaaaggggucuacgaacugcagaguuuggaccucaauauggagacgcugaacaugaccaugccucugagcuguacaaagaauaacucccaucacuauauaagggugggaaaugauacuggccucgaauuaacccugacaaacaccucuauccuuaaucauaaauuuugcaacuugucggacgcccacaagaaagaucuguacgaccaugcgcuaaugucaauuaucagcacuuuccaccucaguauuccaaauuuuaaccaguaugaggcuauguccugugauuucaauggugggaagaucucuguucaguacaaccugagccacuccuaugccauagacgcagccaaucauugcggaacaguggcuaacggcauucuucaaaccuuuaugcggauggcauggggcgggucauacaucgcccuggauaguggacgcgguaacugggacuguauuaugacgagcuaccaguauuugaucauccagaauacuaccugggagaaccacugccaguucucucgaccgucccccauuggcuaccucgggcuguuaucacaacguacaagagauauauauaucagcaggcggcugcucggaacuuuuaccuggacacuuagugacucugaaggcaaugcuaccccugguggguacugucugacgcgcuggauguugauugaggccgaacuaaagugcuucggaaacacugcggucgcaaaauguaaugagaagcaugaugaggaauuuugcgacaugcugagacucuucgauuuuaacaaacaggccaucuccaggcugaagucugaggcucagaugucgauacagcuuauuaauaaagccgugaacgcacugaucaaugaccaauugaucaugaagaaccaccuccgggacauuaugggcaucccauauugcaauuacucuaaguauugguaccugaaccacacaauuaccggcaaaacuuccuuacccaaguguuggcugguaucaaaugggaguuaccuaaacgaaacacauuucagcgaugacauagagcagcaggcugauaauaugaucaccgaaaugcuccaaaaagaguauauggagcgccagggaaagacgccucugggucuuguugacuuguucguguuuuccaccucuuucuaccugauuagcaucuuucuccgacuggucaaaaucccaacacacagacauauugugggcaagcccugcccuaaaccacacaggcuuaaccauauggggauauguucaugcggacuguauaagcagccgggcgugcccguccgguggaagcguuga

SEQ ID NO: 1503 - RNA, 1473 nt, Artificial Sequence
  derived and/or modified CDS sequence (opt3) from Lassa virus__AAL13212__GPC
augggccagaucgugaccuucuuucaagaggucccccacguuauugaagagauaaugaacaucgugcugauuacacucagccuucuggccaucuugaaggggguauacaauuuagcuacuugcggacugauuggucuaaucacguuccucuuucuguguggcagauccugcucuaugaccuauaaagggucauaccagcuugaaacacuggaguugaacauggaaacucucaauaugaccaugccucugaguuguacaaagaacaccagccaucacuauauaagggugggaaaugagacuggccuggagcucacauuaaccaacacguccaucauuaaucauaaauucugcaaccugucugacgcacacaagaaaaaucuuuacgaucauucguugaugucaaucauuagcacuuuucaccugaguaucccaaacuucaaucaguaugaagccauguccugugacuuuaacggugggaagauaucuauucaguacaaucuaagccacaccuaugcgggagaugcugccaagcauugcggcacacucgcaaacggcauccugcaaacuuucaugcggauggccuggggaggguccuacauugcucuugacucaggucgcggcaauugggauuguaucaugaccaguuaccaguaucugaucauucagaacacaaccugggaggaccacugccaguuuagccgaccgucucccauaggguacuugggacuccugucccaacguacgagagaaaucuauauuucaaggcgguuacugggcacuuucacauggacccucagcgauagugaggguaacgagaauccugggggauacugucuuacucgcuggaugcugaucgaagcagaguugaaaugcuuuggcaacacagccgucgcuaaguguaaugaaaaacaugacgaggaguucugcgauaugcuaagacuguuugacuucaacaagcaggccauacagaggcucaaagcggaagcacagaugucuauucaacugaucaauaaggccgugaacgcucuuaucaaugaucagcugauuaugaagaaccacuugcgggacaucaugggcauuccauauugcaauuacuccaaauauugguaccucaaccacaccacgaccgggcgcacaagccugccccgauguugguuaguuucgaauggaucuuaccugaacgagacuagauucuccgaugacauagaacagcaagccgacaauaugaucaccgagaugcuacagaaggaauauauugauaggcaggguaaaacaccucucggccugguggaccuuuuugucuucucaaccaguuuuuacuugaucagcaucuuccugcaucucauuaagauaccaacucaccggcauaucguagggggacccugcccuaaaccacaccgucugaaccauaagggcauuuguuccugcggucuuuauaaacgcccgggggugucuguuagauggaagagguga

SEQ ID NO: 1504 - RNA, 1476 nt, Artificial Sequence
  derived and/or modified CDS sequence (opt3) from Lassa virus__AAO59512__GPC
augggccagaucgugaccuucuuucaagaggucccccacguuauugaagaggugaugaacauaguacugaucgcccucagcauucuugcugugcugaagggguuguacaauuucgcaacaugcggauuagucggucugguggccuuucuacuccuguguggcagauccugcacuucuucacuuuauaaagggguuuacgaacugcagacguuggagcucaacauggaaacccugaauaugacaaugccucugaguuguacuaagaacaauagccaucacuauaucagggugggaaacgagaccggccucgaguuaacacugaccaauacuuccauuaucaaccauaaauucugcaaucuuucugacgcgcacaagaaaaacuuguacgaucaugcucugaugucgauaaucucaacauuucaccuaagcauuccaaauuucaaccaguaugaagccaugaguugugacuuuaauggugggaagaucuccguccaguacaaccucucucacagcuaugcaguggaugccgcuaagcauugcggaaccguagcaaauggcguucugcaaacguucaugcggauggccuggggcggguccuacauugcucuugacucaggacacggucgcugggauuguaucaugaccaguuaccaguaucugauaauucagaacacuacaugggaggaccauugccaguuuagccgaccgucucccaucggcuacuuggggcuccugucccaacguacuagagauauuuauaucucaaggcgguuacugggaaccuucacauggacccucagcgacagugaaggcaaagauacgccugguggguacugucuuacucgcuggaugcugaucgaggccgaguugaagugcuuuggaaacacagcgguggcaaaauguaaugaaaagcacgacgaggaguucugcgauaugcuaagacuguuugacuucaacaaacaggccauucagaggcucaagaccgaagcucagaugucuauacaacugaucaauaaggccgucaacgcacuuauuaaugaucagcugaucaugaaaaaccacuugcgggacauaaugggcauuccauauugcaauuacucccgcuauugguaccucaaccauacuacaaccggcaagacgagccugcccaaauguugguuagugucgaaugggucuuaccugaacgaaacccgauucuccgacgauaucgagcagcaagcugacaauaugaucacagagaugcuacagaaggaauauauggagagacagggaaaaacuccucucggucugguggaucuuuuugucuucucaaccaguuuuuacuugauuagcaucuuccugcaccucguuaagauuccaacacauaggcacauagugggcaaauccugccccaagccucaucggcugaaccacauggggaucuguucuugcggacuuuauaagcagccaggcguaccggugaaauggaagcguuga

SEQ ID NO: 1505 - RNA, 1476 nt, Artificial Sequence
  derived and/or modified CDS sequence (opt3) from Lassa virus__AAT49000__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuauuucucuguggcagauccugcucuacgucacuguauaaagggguuuacgaacuucagacccuggaguugaacauggaaacacucaauaugacuaugccucugaguuguaccaagaacaauagccaucacuauauuauggugggaaacgagacaggccuggagcucaccuuaacuaauacauccaucauaaaccauaaauucugcaaucugucugacgcccacaagaaaaaccuuuacgaucauaccuugaugucgaucauuucaacguuucaccugagcaucccaaauuucaaccaguaugaagcgaugaguugugacuuuaauggugggaagauuuccguccaguacaaccuaucucacagcuaugcuguggaugccgcaaaucauugcggaacuguagccaacggcguucuccaaaccuucaugaggauggcuuggggcggguccuacaucgcacuggacucaggacgggguaacugggauuguauaaugacaaguuaccaguaucuugugauucagaauacuaccugggaggaccacugccaguuuagccgcccgucucccaucggcuaccugggguugcucucccaacgaacacgugauauuuauaucucaagaaggcuguuaggaaccuucacguggacucugagcgacagugaaggcaaggauacaccugguggguacugucucacccgguggaugcuuaucgaggccgagcugaaaugcuuuggaaacacugcugucgccaaguguaaugaaaaacaugacgaggaguucugcgauauguugcgccuauuugacuucaacaagcaggcgauucagagacugaaagcagaagcccagaugucuauacaacucaucaauaaggcugugaacgcccugauuaaugaucagcuuaucaugaagaaccaccugagggacauaaugggcauuccauauugcaauuacuccaaauauugguacuugaaccacacagugaccggcaagacgagccuccccaaauguuggcuggucucgaaugggucuuacuuaaacgaaacccauuucuccgacgauaucgagcagcaagcagacaaucugaucacagagaugcuacagaaggaauauauggagcggcagggaaaaacuccucucggucugguugaucuuuuuguguucucaaccaguuuuuacuugauuagcaucuuccugcaccucguaaagauuccaacacaucgccacauagugggcaaacccugcccuaagccacaucgacugaaccacauggggaucuguuccugcggagucuauaagcagccgggcgugcccguuagauggaaaagguga

SEQ ID NO: 1506 - RNA, 1476 nt, Artificial Sequence
  derived and/or modified CDS sequence (opt3) from Lassa virus__AAT49004__GPC
augggccagaucgugaccuucuuucaagaggucccccacguuauugaagaggugaugaacauaguacugaucgcccucagcgugcuugcuguccugaagggguuguacaauuucgcaacaugcggauuagugggucugguuacuuuucuacuccuguguggcagauccugcacgaccucucuuuauaaagggguguacgaacugcagacauuggagcucaacauggaaacucugaauaugaccaugccucugucauguacaaagaacaauagucaucacuauauuauggucggaaacgagaccggccucgaguuaacucugacaaauaccagcaucauuaaccauaaauucugcaaucuuuccgacgcccacaagaaaaacuuguacgaucaugcgcugaugucuaucauaucgacguuucaccuaucaaucccaaauuucaaccaguaugaagcuaugagcugugacuuuaauggugggaagauuagugugcaguacaaccucucccacucuuaugccggagaugcagccaaucauugcggcacuguagcuaacggcguucugcaaaccuucaugaggauggcauggggagggagcuacaucgcccuugacuccggucggggcaacugggauuguauuaugacaucauaccaguaucugaucauacagaauacuaccugggaggaccacugccaguuuagucgcccgagccccauuggguacuugggacuccugucucaacgaacacgugauaucuauauuuccagaagguuacugggcaccuucacguggacucucucagacagcgaagguaaggauacaccugggggauacugucuuacccgguggaugcugaucgaggcugaguugaaaugcuuuggcaacacugccguggcgaaguguaaugaaaaacaugacgaggaguucugcgauaugcuacgccuguuugacuucaacaagcaggcaauccagagacucaaagccgaagcucagaugaguauucaacugauaaauaaggccgucaacgcacuuaucaaugaucagcugauuaugaagaaccacuugagggacaucaugggcauaccauauugcaauuacucuaaauauugguaccucaaccacacaaccacggggcggaccucccugcccaaguguugguuagugagcaauggaucguaccugaacgaaacacauuucucugacgauauugagcagcaagcugacaauaugaucacugagaugcuacagaaagaauauauggagcgccaggguaagaccccucucggccugguggaucuuuuugucuucuccacaucauuuuacuugaucaguauuuuccugcaccucguuaaaaucccaacucaucgacacauugugggaaagagcugccccaaaccucauagacugaaccacauggggauauguuccugcggccuuuauaagcagccagguguaccggugaaguggaaaagguga

SEQ ID NO: 1507 - RNA, 1476 nt, Artificial Sequence
  derived and/or modified CDS sequence (opt3) from Lassa virus__AAT49008__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuauuucucuguggcagauccugcucuacgacccuguauaaagggguuuacgaacuucagacacuggaguugaacauggaaacucucaauaugaccaugccucugucauguacaaagaacaauagucaucacuauauuauggugggaaacgagaccggccuggagcucacuuuaacaaauaccagcaucauaaaccauaaauucugcaaucuguccgacgcccacaagaaaaaccuuuacgaucauacguugaugucuaucauuucgacuuuucaccugucaaucccaaauuucaaccaguaugaagcgaugagcugugacuuuaauggugggaagauuaguguccaguacaaccuaucccacucuuaugcuguggaugccgcaaaucauugcggaaccguagccaacggcguucuccaaacauucaugaggauggcuuggggcgggagcuacaucgcacuggacuccggacgggguaacugggauuguauaaugacuucauaccaguaucuuauuauccagaauaccacaugggaggaccacugccaguuuagucgcccgagccccauuggcuaccugggguugcucucucaacgaacccgugauaucuauaucuccagaaggcuguuaggaacguucacuuggacacugucagacagcgaaggcaaggauaccccugguggguacugucucacucgguggaugcuuauugaggccgagcugaaaugcuuuggaaacacagcuguggccaaguguaaugaaaaacaugacgaggaguucugcgauauguugcgccuauuugacuucaacaagcaggcgauacagagacugaaagcagaagcccagaugaguauccaacucauuaauaaggcugucaacgcccugaucaaugaucagcuuauaaugaagaaccaccugagggacauuaugggcaucccauauugcaauuacucucgguauugguacuugaaccacaccgugacgggcaaaaccucccuccccaaguguuggcuggugagcaaugggucguacuuaaacgaaacacauuucucugacgauaucgagcagcaagcagacaaucugauuacugagaugcuacagaaagaauauauggagcgccagggaaagaccccucucggucuggucgaucuuuuuguuuucuccacaucauuuuacuugaucaguauuuuccugcaccucgugaaaauaccaacucaucgacacaucguaggcaagcccugcccuaaaccacauagacugaaccacauggggauuuguagcugcggaguguauaagcagccgggcguccccgugagguggaagcgguga

SEQ ID NO: 1508 - RNA, 1473 nt, Artificial Sequence
  derived and/or modified CDS sequence (opt3) from Lassa virus__AAT49010__GPC
augggccagaucgugaccuucuuucaagaggucccccacguuauugaagaggugaugaacauaguacugaucgcccucagcgugcuugcuauucugaagggguuguacaauuucgcaacaugcggauuaaucggucuggucacuuuucuacuccuguccggcagaucuuguucaaugauuuauaaagggguguacgaacuucagacgcuggaguugaacauggaaacccucaauaugacaaugccucugaguugcacuaagaacaccagccaucacuauaucaggguuggaaaugacacaggccuggagcucaccuuaacuaacgagacacugcuucaucacaaauucuguaauuuguccgaugcccauaagcggaaccuguacgaccacgcgcuaaugucuauaaucucgaccuuucaccucucaauuccaaauuucaaccaguaugaagcuaugagcugcgauuuuaauggugggaaaaucacggugcaguacaaccugagucauuccuaugccgucgacgcagccaagcacuguggaacuguggcuaauggcguacuucaaaccuucaugcgcauggcauggggcgggucuuacauugcccuggauagccgacauggaaacugggacugcaucaugacauccuaccaguauuugauaauucagaauacuaccugggaggaucacugucaguuuucacguccgagucccaucgguuaccucggccuguuaagccaaagaacaagggacauuuauaucucucggcgccugcucgggaccuucacguggacucuuuccgauucagaaggaaacgagacaccuggcgguuacugccugaccagauggauguugaucgaggcugaacuaaaguguuuugggaacacugccguugcgaaaugcaaugagaagcacgacgaagaguucugugauaugcugaggcucuuugacuucaacaaacaggcaauucggcgccugaagacagaagcccagaugagcauacagcuuaucaauaaagcugugaacgcccugauuaaugaucaauugaucaugaagaaccaucuccgagacauaaugggcauuccauauugcaauuacaguaaguauugguaccugaaccacaccucuacgggaaaaaccuccuuacccagaugcuggcuggucagcaauggcucguaccuaaacgagacacauuucucugacgauaucgagcagcaggcagacaauaugaucacugaaaugcuccaaaaggaguaucuggauaggcaggggaaaaccccucuuggauugguggaccuguuuguguucuccacaucauuuuaccucauuaguaucuuccugcaccuuauuaagauaccaacucaucggcacaucgucgguaaacccuguccuaagccacaccgucugaaccauaugggcauuugcagcuguggguuguauaaacagccgggaguucccgugcgcuggaagagauga

SEQ ID NO: 1509 - RNA, 1473 nt, Artificial Sequence
  derived and/or modified CDS sequence (opt3) from Lassa virus__AAT49014__GPC
augggccagaucauuaccuucuuucaagaggugccccacgucauagaagagguuaugaacaucgugcugauugcccucagccuucuggcuaucuugaagggguuauacaauauugcaacaugcggaaucauaggucugguagccuuccuauuucucuguggcaaauccugcucucugacucuuaaagggggauaugaacugcagacguuggagcucaacauggaaacccugaauaugacaaugccucugucauguacuaagaacaguagccaucacuacaucagagugggcaaugagaccggucucgaguuaacacugaccaacacuuccauuaucaaucauaaguucugcaaccuuucugacgcgcacaaaaagaauuuguaugaucaugcucugaugucgauuaucucaacauuucaccuaagcauaccaaacuucaaucaguacgaagccaugaguugugacuuuaacgggggaaagauuuccguccaguauaaucucucucacagcuacgcaggcgaugccgcugagcauugcggcaccguggcaaacgggguucugcaaacguucaugaggauggccuggggaggucgguauaucgcucuugacuccggcaaagggaauugggauuguauuaugacuucauaccaguaccugaucauccagaacaccacaugggaagaccacugccaguuuagucgcccgagccccauuggauauuugggccuccugucucaacgaacucgugauauauacaucuccagaagguuacuggguaccuucacauggacccucucagacagcgaggggaacgagacgccuggaggcuauugucuuacucgguggaugcugauugaagccgaguugaagugcuuuggcaauacagcgguggcaaaauguaacgaaaagcaugaugaggaguucugcgacaugcuacgccuguuugauuucaauaaacaggccaucagaaggcucaaggcugaagcccagaugaguauacagcugauuaacaaggcagucaaugcucuuaucaacgaccaacugaucaugaaaaaucacuugcgggauauuauggggaucccauacugcaacuauucuaaguacugguaucucaaucacaccuccagcggacgcacuucgcugcccaaauguugguuaauuucuaacgguuccuaccugaaugagacacaguucucagacgacauagaacagcaagccgaucauaugaucaccgagaugcuacagaaggaauacauugagcgacagggcaaaacgccucucgggcugguggacaucuuuaucuucaguaccagcuuuuaucuuauuuccauauucuugcaccugaucaagauuccaacacauagacacaucguaggaaaacccugcccuaagccacauaggcucaaccacaugggcguuuguucuugcggucuguacaagcacccgggggugcccacuaaauggaagcgguga

SEQ ID NO: 1510 - RNA, 1476 nt, Artificial Sequence
  derived and/or modified CDS sequence (opt3) from Lassa virus__AAV54104__GPC
augggccagaucgugaccuucuuucaagaggucccccacguuauugaagaggugaugaacauaguacugaucgcccucagcgugcuugcuguccugaagggguuguacaauuucgcaacaugcggauuagugggucugguuacuuuucuacuccuguguggcagauccugcacgaccucucuuuauaaagggguguacgaacugcagacauuggagcucaacauggaaacucugaauaugaccaugccucugucauguacaaagaacaauagucaucacuauauuauggucggaaacgagaccggccucgaguuaacucugacaaauaccagcaucauuaaccauaaauucugcaaucuuuccgacgcccacaagaaaaacuuguacgaucaugcgcugaugucuaucauaucgacguuucaccuaucaaucccaaauuucaaccaguaugaagcuaugagcugugacuuuaauggugggaagauuagugugcaguacaaccucucccacucuuaugccggagaugcagccaaucauugcggcacuguagcuaacggcguucugcaaaccuucaugaggauggcauggggagggagcuacaucgcccuugacuccggucggggcaacugggauuguauuaugacaucauaccaguaucugaucauacagaauacuaccugggaggaccacugccaguuuagucgcccgagccccauuggguacuugggacuccugucucaacgaacacgugauaucuauauuuccagaagguuacugggcaccuucacguggacucucucagacagcgaaggugaggauacaccugggggauacugucuuacccgguggaugcugaucgaggcugaauugaagugcuuuggcaacacugccguggcgaaauguaaugagaagcaugacgaagaguucugcgauaugcuacgccuguuugacuucaacaaacaggcaauccagagacucaaggccgaagcucagaugaguauucaacugauaaauaaagccgucaacgcacuuaucaaugaucagcugauuaugaagaaccacuugagggacaucaugggcauaccauauugcaauuacucuaaguauugguaccucaaccacacaaccacggggcggaccucccugcccaaauguugguuagugagcaauggaucguaccugaacgagacacauuucucugacgauauugagcagcaagcugacaauaugaucacugaaaugcuacagaaggaguauauggaacgccaggguaaaaccccucucggccugguggaucuuuuugucuucuccacaucauuuuacuugaucaguauuuuccugcaccucguuaagaucccaacucaucgacacauuguggggaaaagcugccccaagccucauagacugaaccacaugggaauauguuccugcggccuuuauaaacagccagguguaccggugaaguggaagagguga

SEQ ID NO: 1511 - RNA, 1476 nt, Artificial Sequence
  derived and/or modified CDS sequence (opt3) from Lassa virus__ADI39451__GPC
augggccagaucgugaccuucuuucaagaggucccccacguuauugaagaggugaugaacauaguacugaucgcccucagcgugcuugcuguccugaagggguuguacaauguggcaacaugcggauuaauuggucugaucgccuuccuacuccuguguggcagauccugcacuacgacccuuuauaaagggguuuacgaacugcaggcguuggagcucaacauggaaacacugaauaugacuaugccucugucuuguaccaagaacaauucacaucacuauauuauggugggaaacgagacaggccucgaguuaacccugacuaauacaaguaucauaaaccauaaauuuugcaaucuuagcgacgcucacaagaaaaacuuguacgaucaugcccugauguccaucauuucuaccuuccaccuaucgaucccaaauuuuaaccaguaugaagcaaugucaugugacuucaauggugggaagauuagcguccaguacaaccucagucacacguaugccguggaugcugcaaaucauugcggaacuguagccaacggcguucugcaaaccuuuaugaggauggcuuggggcggguccuacaucgcccuugacucuggacgggguagcugggauuguauaaugacauccuaccaguaucugauuauccagaacacuaccugggaggaccacugccaguucucacgcccgagucccauuggcuacuuggggcuccugagccaacgaacacgugauaucuauaucucuagaagguuacugggaaccuuuacguggacucucuccgacucagaaggcaaggauacaccugguggguacugucuuacccgguggaugcugauugaggcggaguugaaaugcuucggaaauacugcaguggccaaguguaacgaaaaacaugacgaggaauuuugcgauaugcuacgccuguucgacuuuaauaagcaggcuauacagagacucaaagccgaggcacagaugagcauccaacugauuaacaaggcugucaaugcccuuaucaacgaucagcugauaaugaagaaucacuugagggacauuaugggcaucccauauugcaacuacaguaaauauugguaccucaaucacacaaucaccggccggacgucucugcccaaguguugguuaguguccaacgggagcuaccugaaugaaacccauuucucggacgauauugagcagcaagcggacaacaugaucacagagaugcuacagaaagaauauauugagcgccagggaaagacuccucucggucugguggaucuuuucgucuuuucuaccuccuucuacuugauaucaaucuuucugcaccucauuaaaaucccaacacaucgacacaucguuaauaagcccugcccuaaaccacauagacugaaccacaugggcguguguaguugcgggcuuuauaagcagccgggaguacccgugagguggaagcgguga

SEQ ID NO: 1512 - RNA, 1473 nt, Artificial Sequence
  derived and/or modified CDS sequence (opt3) from Lassa virus__ADU56610__GPC
augggccagaucgugaccuucuuucaagaggucccccacguuauugaagaggugaugaacauaguacugaucgcccucagccuucuggcuauuuugaaggggaucuacaauguggcaacaugcggauuauucggucugauuuccuuucuacuccuguguggcagaucuugcucaacuacguauaaaggggucuacgaacuucagacccuggaguuggacauggccaaccucaauaugacaaugccucugaguuguacuaagaacagcucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaacugggacuguaucaugaccaguuaccaguaucuuauuauccagaacacuacaugggaagaucacugccaguuuagccggccgucucccaucggcuaccugggguugcucucccaacgcacucgagacauuuauauaucacguagacuguuaggaaccuucacauggacccugagcgauagugagggcaaugaagcgccugguggguacugucucacgagguggaugcuuaucgaggcagagcugaaaugcuuuggaaacacugccauugcuaaguguaaugaaaaacaugacgaggaguucugcgauauguugcggcuauuugacuucaacaagcaggccaucaaacgccugaaggcagaagcucagaugucuauacagcucauuaauaaggccgugaacgcgcugaucaaugaucaacuuaucaugaaaaaccaccugagagacauuaugggcaucccauauugcaauuacuccaaguauugguacuugaaccacacaguaaccggcaaaacuagccuccccagguguuggcugauuucgaaugggucuuacuuaaacgaaacacauuucuccgacgauauagagcagcaggccgacaauaugaucaccgagcugcuacaaaaggaauauauggaucggcagggaaaaacgccucucggucugguugaccuuuuuguguucucaaccaguuuuuacuugauuagcaucuuccugcaccucgucaagaucccaacacaucgccacauugugggccgacccugcccuaaaccacauagacugaaccacauggggauauguuccugcggacuuuauaagcacccgggcgugcccgucaaguggaaaagguga

SEQ ID NO: 1513 - RNA, 1473 nt, Artificial Sequence
  derived and/or modified CDS sequence (opt3) from Lassa virus__ADU56618__GPC
augggccagaucgugaccuucuuucaagaggucccccacguuauugaagaggugaugaacauaguacugaucgcccucagcauucuugcuauccugaagggguuguacaauauugcaacaugcggauuaaucggucuggugacuuuccuacuccuguccggcagaucuuguucaaugacguauaaaggggucuacgaacuucagacccuggaguugaacaugaauacacucaacaugacuaugccucugaguugcaccaagaauaacagccaucacuauauaauggugggaaaugaaacaggccuggagcucaccuuaacuaacacaucccugcuucaucacaaauuuuguaauuugucugacgcccauaagaaaaaccuguacgaucacacccuaaugucgaucauuucaacguuccaccucagcaucccaaauuuuaaccaguaugaggcgaugaguugcgacuucaauggugggaagauuacuguucaguacaaccugucccauucuuaugcuaucgaugccgcaaaucacuguggaaccguggccaacggcguccuucaaacauuuaugaggauggcuuggggcgggagcuacauagcacuggacuccggacgggguaagugggauugcauuaugacuucauaccaguauuugaucauucagaacaccacaugggaagaccauugucaguucagucgcccgagccccaucggcuaccucgggcuguuaucucaacgaacccgugauaucuauauuuccagaaggcugcucggaacguuuacuuggacacuuucagacagcgagggcaaugaaaccccugguggguacugccugacucgguggauguugauagaggccgagcuaaaauguuucggaaacacagcuguggccaagugcaaugaaaaacacgaugaggaauuuugugacaugcugcgccucuucgauuuuaacaagcaggcgaucagaaggcugaaagcagaggcccagaugaguauucagcuuaucaauaaggcuguaaacgcccugauaaaugaccaauugauuaugaagaaccaccuccgggauaucaugggcaucccauauugcaauuacucuaaauauugguaccugaaccauaccuccacgggccgcaccagcuuaccccgaugcuggcugguuucgaaugggucuuaccuaaacgaaacacacuucuccgacgacauugagcagcaggcagauaauaugaucacugagaugcuccaaaaggaauaucuggacagacagggaaaaaccccucuugguuugguggaucuguucgucuuuucaacaaguuucuaccucauuagcauauuucugcaucuugugaagaucccaacucacaggcauauugugggcaaacccuguccuaagccacaccggcugaaccacauggggaucugcuccuguggauuguauaaacagccgggcguccccguucguuggaagcgcuga

SEQ ID NO: 1514 - RNA, 1473 nt, Artificial Sequence
  derived and/or modified CDS sequence (opt3) from Lassa virus__ADU56622__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaauaccgcgguggcaaaguguaacgaaaaacaugacgaggaguucugcgauauguugcggcuauuugacuucaauaagcaggccauucgcagacugaaaacugaagcucagauguccauccagcucauaaacaaggccguaaaugcacugauuaacgaucaacuuaucaugaagaaucaccugagggacaucaugggcauuccauauugcaacuacagcaaauauugguacuugaaucacacaguuaccggcaagacgucgcucccccgguguuggcuggugucuaacggguccuacuuaaaugaaacccauuucucagacgauaucgagcagcaggcugacaacaugauuacagagcugcuacaaaaagaauauauagaucgccagggaaagacuccucucggucuggucgaccuuuuuguguucaguaccagcuuuuacuugaucuccauuuuccugcaccucgugaaaaucccaacacaucgacacgucaucggcaagcccugcccuaaaccacauagacugaaucacauggggauuuguucuugcggacuuuauaagcacccgggcguucccgugaaguggaaaagguga

SEQ ID NO: 1515 - RNA, 1473 nt, Artificial Sequence
  derived and/or modified CDS sequence (opt3) from Lassa virus__ADU56626__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguugaacauggccagucucaauaugacaaugccucugagcuguacuaagaacaauucccaucacuauaucauggugggaaacgaaaccggccuggagcucacauuaaccaauacuucuauaaucaaccauaaauucugcaaucugucggacgcgcacaagaggaaccuuuacgaucaugcuuugaugucaauuaucagcacauuucaccugaguauuccaaauuucaaccaguaugaggccauguccugugacuuuaauggugggaaaaucucuguucaguacaaccuaagccacaccuaugcaguggaugccgcuaagcauugcggaacgauagcaaauggcguccuccaaacuuucaugcggauggccuggggcggguccuacauugcucuggacucaggaaaggguaguugggauuguaucaugaccagcuaccaguaucuuauuauccagaacacaacuugggaagaccacugccaguuuucucgcccgucccccaucggcuaccugggguugcucucacaacgaacccgugauauuuauauaagcagaaggcuguuaggaacauucaccuggacgcugagugacucugagggcaacgaaacuccugguggguacugucucacacgguggaugcuuaucgaggccgagcugaaaugcuuuggaaauaccgcgguggcaaaguguaacgaaaaacaugaugaggaguucugcgacauguugcgccuauuugauuucaauaagcaggccauuagaaggcugaaagcugaagcccagauguccauccagcucauaaacaaggcaguaaaugcucugauuaacgaccaacuuaucaugaagaaucaucugcgggauaucaugggcauuccauauugcaacuacagcaaauauugguacuugaaucacacuguuacaggcaagaccucgcucccccgcuguuggcuggugucuaacggguccuacuuaaaugaaacgcacuucucagacgacaucgagcagcaggccgauaacaugauuaccgagcugcuacaaaaagaauauauagaccgacagggaaagacaccucucggucuggucgaucuuuuuguguucaguacuagcuuuuacuugaucuccauuuuccugcaccucgugaaaaucccaacccauagacacgucaucggcaagcccugcccuaaaccacauaggcugaaucacauggggauuuguucuugcggacuuuauaagcacccgggcguucccgugaaguggaaacgguga

SEQ ID NO: 1516 - RNA, 1473 nt, Artificial Sequence
  derived and/or modified CDS sequence (opt3) from Lassa virus__ADU56630__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaguugggacuguaucaugacuagcuaccaguaucuuauuauccagaacaccacaugggaagaucacugccaguuuucucggccgucccccaucggcuaccugggguugcucucacaacgcacucgagacauuuauauaagccguagacuguuaggaaccuucacauggacccugagugauucugagggcaacgaaacgccugguggguacugucucacuagguggaugcuuaucgaggcggagcugaaaugcuuuggaaauacagcaguggccaaguguaacgaaaaacaugacgaggaguucugcgauauguugcggcuauuugacuucaauaagcaggcuauucgcagacugaaaaccgaagcccagauguccauccagcucauaaacaaggcaguaaaugcucugauuaacgaucaacuuaucaugaagaaucaccugagggacaucaugggcauuccauauugcaacuacagcaaauauugguacuugaaucacacuguuacaggcaagaccucgcucccccgguguuggcuggugucuaacggguccuacuuaaaugaaacgcauuucucagacgauaucgagcagcaggccgacaacaugauuaccgagcugcuacaaaaagaauauauggaucgccagggaaagacaccucucggucuggucgaccuuuuuguguucaguacuagcuuuuacuugauauccaucuuccugcaccucgugcgaaucccaacccauagacacgucauuggcaaacccugcccuaagccacauaggcugaaucacauggggaucuguucuugcggacuuuauaaacacccgggcguucccgugaaguggaagcgguga

SEQ ID NO: 1517 - RNA, 1476 nt, Artificial Sequence
  derived and/or modified CDS sequence (opt3) from Lassa virus__AFY05588__GPC
augggccagaucgugaccuucuuucaagaggucccccacguuauugaagaggugaugaacauaguacugaucgcccucagcgugcuugcuguccugaagggguuguacaauuucgcaacaugcggauuagugggucugguuacuuuucuacuccuguguggcagauccugcacgaccucucuuuauaaagggguguacgaacugcagacauuggagcucaacauggaaacucugaauaugaccaugccucugucauguacaaagaacaauagucaucacuauauuauggucggaaacgagaccggccucgaguuaacucugacaaauaccagcaucauuaaccauaaauucugcaaucuuuccgacgcccacaagaaaaacuuguacgaucaugcgcugaugucuaucauaucgacguuucaccuaucaaucccaaauuucaaccaguaugaagcuaugagcugugacuuuaauggugggaagauuagugugcaguacaaccucucccacucuuaugccggagaugcagccaaucauugcggcacuguagcuaacggcguucugcaaaccuucaugaggauggcauggggagggagcuacaucgcccuugacuccggucggggcaacugggauuguauuaugacaucauaccaguaucugaucauacagaauacuaccugggaggaccacugccaguuuagucgcccgagccccauuggguacuugggacuccugucucaacgaacacgugauuuauauaucuccagaaggcugcucggcaccuucacguggacucuuucagacagcgaaggugaggauacaccugggggauacugucugacccgguggauguugauugaggcugaacuaaagugcuuuggcaacacugccguggcgaaauguaaugagaagcaugacgaagaguucugcgauaugcugcgccucuuugacuucaacaaacaggcaauccagagacugaaggccgaagcucagaugaguauccaacuuauuaauaaagccgucaacgcacugauaaaugaucaguugaucaugaagaaccaccucagggacauuaugggcaucccauauugcaauuacucuaaguauugguaccugaaccacacaaccacggggcggaccuccuuacccaaauguuggcuggugagcaauggaucguaccuaaacgagacacauuucucugacgauauagagcagcaagcugacaauaugauuacugaaaugcuccagaaggaguauauggaacgccaggguaaaaccccucugggccuuguggauuuguuugucuucuccacaucauuuuaccugaucaguaucuuccuccaccugguuaagauuccaacucaucgacacaucguggggaaaagcugccccaagccucauagacuuaaccacaugggaauuuguuccugcggccuguauaaacagccagguguaccggugaaguggaagagguga

SEQ ID NO: 1518 - RNA, 1476 nt, Artificial Sequence
  derived and/or modified CDS sequence (opt3) from Lassa virus__AFY05590__GPC
augggccagaucgugaccuucuuucaagaggucccccacguuauugaagaggugaugaacauaguacugaucgcccucagcgugcuugcuguccugaagggguuguacaauuucgcaacaugcggauuagugggucugguuacuuuucuacuccuguguggcagauccugcacgaccucucuuuauaaagggguguacgaacugcagacauuggagcucaacauggaaacucugaauaugaccaugccucugucauguacaaagaacaauagucaucacuauauuauggucggaaacgagaccggccucgaguuaacucugacaaauaccagcaucauuaaccauaaauucugcaaucuuuccgacgcccacaagaaaaacuuguacgaucaugcgcugaugucuaucauaucgacguuucaccuaucaaucccaaauuucaaccaguaugaagcuaugagcugugacuuuaauggugggaagauuagugugcaguacaaccucucccacucuuaugccggagaugcagccaaucauugcggcacuguagcuaacggcguucugcaaaccuucaugaggauggcauggggagggagcuacaucgcccuugacuccggucggggcaacugggauuguauuaugacaucauaccaguaucugaucauacagaauacuaccugggaggaccacugccaguuuagucgcccgagccccauuggguacuugggacuccugucucaacgaacacgugauauguauaucuccagaagguuacugggcaccuucacguggacucucucagacagcgaaggugaggauacaccugggggauacugucuuacccgguggaugcugauugaggcugaauugaagugcuuuggcaacacugccguggcgaaauguaaugagaagcaugacgaagaguucugcgauaugcuacgccuguuugacuucaacaaacaggcaauccagagacucaaggccgaagcucagaugaguauccaacugauuaauaaagccgucaacgcacuuauaaaugaucagcugaucaugaagaaccacuugagggacauuaugggcaucccauauugcaauuacucuaaguauugguaccucaaccacacaaccacggggcggaccucccugcccaaauguugguuagugagcaauggaucguaccugaacgagacacauuucucugacgauauagagcagcaagcugacaauaugauuacugaaaugcuacagaaggaguauauggaacgccaggguaaaaccccucucggccugguggaucuuuuugucuucuccacaucauuuuacuugaucaguaucuuccugcaccucguuaagauuccaacucaucgacacaucguggggaaaagcugccccaagccucauagacugaaccacaugggaauuuguuccugcggccuuuauaaacagccagguguaccggugaaguggaagagguga

SEQ ID NO: 1519 - RNA, 1476 nt, Artificial Sequence
  derived and/or modified CDS sequence (opt3) from Lassa virus__AHC95553__GPC
augggccagaucgugaccuucuuucaagaggucccccacguuauugaagaggugaugaacauaguacugaucgcccucagcauucuugcugugcugaagggguuguacaauaucgcaacaugcggauuaauuggucuggucacuuucuuucuacucuguggcagauccugcaguucaaaccuguauaaagggguguacgaacuucagagucuggacuugaauauggagacgcucaacaugaccaugccucugagcuguacaaagaauaacucccaucacuauaucaggguuggaaaugaaacuggccuggagcucaccuuaacaaacaccucucugcuugaucauaaauucugcaauuugucggacgcccacaagaaaaaccuguacgaucaugcgcuaaugucaauaaucagcacuuuucaccucaguauuccaaauuucaaccaguaugaggcuauguccugugacuuuaauggugggaagaucacagugcaguacaaccugucucacagcuaugccggagaugcagcccggcauugcggcaccauugcuaauggcguccuucaaacguucaugcgcauggcauggggaggguccuacaucgcccuggacucaggucacggcaacugggauuguauaaugacuucuuaccaguauuugauuauccagaacaccacaugggaagaccauugccaguuuagccgaccgucucccauuggguaccucucccuguuaucacaacguacuagagauaucuauaucagcaggcggcugcucggaaccuucacauggacccuuagugacucugagggcaaugcuacgccugguggguacugucugacucgcuggauguugauugaagccgagcuaaagugcuuuggaaacacagcgguggcaaaauguaaugagaagcacgaugaagaguucugcgacaugcugagacucuuugauuucaacaaacaggccauauccaggcugcggagcgaagcucagaugucgauccagcuuauuaauaaggccguaaacgcacugaucaaugaccaauugauaaugaaaaaccaccuccgcgacauuaugggcaucccauauugcaauuacucuaaguauugguaccugaaccauaccguuacuggccgaacauccuuacccaaguguuggcuggugucaaaugggaguuaccuaaacgagacccacuucagcgaugacaucgaacagcaggcugauaauaugauuacggagaugcuccaaaaagaguauauggacagacagggaaagaccccucugggucuugucgauuuguuuguguucuccacaucuuuuuaccugaucagcauuuuccuccaucuggugaaaauaccaacucacaggcauaucgucggcaagcccugcccuaaaccacaccggcuuaaccguauggggauuuguucaugcggacuguauaagcagccgggcguucccgugaaauggaagcgcuga

SEQ ID NO: 1520 - RNA, 1476 nt, Artificial Sequence
  derived and/or modified CDS sequence (opt3) from Lassa virus__AHC95555__GPC
augggccagaucgugaccuucuuucaagaggucccccacguuauugaagaggugaugaacauaguacugaucgcccucagcauucuugcugugcugaagggguuguacaauaucgcaacaugcggauuaauuggucuggucacuuuccuacuccuguguggcagauccugcaguucaaaccuuuauaaagggguguacgaacugcagaguuuggaccucaauauggagacgcugaacaugaccaugccucugagcuguacaaagaauaacucccaucacuauaucagggccggaaaugaaacuggccucgaguuaacccugacaaacaccucucuuauaaaucauaaauuuugcaacuugucggaugcgcacaagaaaaaucuguacgaccauacucuaaugucaaucauuagcacauuccaccucaguaucccaaacuuuaaucaguaugaggcuauguccugugauuucaacggugggaagauuucuguucaguacaaucugagccacgccuaugcaaucgacgccgcugaacauugcggaaccguggcaaacggcguccuucaaacguuuaugcggauggccuggggcggguccuacauagcucuggauucaggacgcgguaacugggacuguauuaugacuucuuaccaguauuugaucauucagaauaccacaugggaggaucacugccaguucagccgaccgucucccaucggcuaccucgggcuguuaucccaacguacuagagacaucuauauuucaaggcggcugcucggaaccuuuacauggacccuuagcgauagugaaggcaacgccacgccugguggguacugucugacucgcuggauguugauagaggcggagcuaaagugcuucggaaauacagcaguggccaaauguaacgaaaagcaugacgaggaauuuugcgauaugcugagacucuucgacuuuaauaaacaggcuaucucuaggcugaaguccgaggcccagaugagcauucagcuuaucaacaaagcaguaaaugcucugauaaacgaucaauugauuaugaagaaucaccuccgggacaucaugggcaucccauauugcaacuacucgaaguauugguaccugaaucacaccauuacuggccgcacaucuuuacccaaauguuggcugguuuccaacgggucauaccuaaaugaaacccauuucagugacgauaucgagcagcaggccgacaacaugauuacggagaugcuccaaaaggaauauauggagcgacagggaaaaaccccucugggucuuguggauuuguucgucuuuagcacauccuucuaccugauaucuaucuuucuccaccuggugaagauuccaacucauagacacaucgugggcaaacccugcccuaagccacauaggcuuaaucacauggggaucuguagcugcggacuguauaaacagccgggcguccccuugaaguggaagcgguga

SEQ ID NO: 1521 - RNA, 1476 nt, Artificial Sequence
  derived and/or modified CDS sequence (opt3) from Lassa virus__AHC95557__GPC
augggccagaucgugaccuucuuucaagaggucccccacguuauugaagaggugaugaacauaguacugaucgcccucagcauucuugcugugcugaagggguuguacaauaucgcaacaugcggauuaauuggucuggucacuuucuuucuacucuguggcagauccuguucuucaaaccuguauaaagggguguacgaacuucagagucuggacuugaauauggagacgcucaacaugaccaugccucugagcugcacaaagaauaacucccaucacuauaucaggguuggaaaugaaacuggccuggagcucaccuuaacaaacaccucucugcuuaaucauaaauucugcaacuugucggaugcccacaagcggaaucuguacgaccaugcgcuaaugucaauaaucagcacuuuucaccucaguauuccaaacuucaaucaguaugaggcuauguccugugauuuuaacggugggaaaaucacagugcaguacaaucugucucacagcuaugccggagacaccgcaaagcauugcggcacgauugccaacggcguccuucaaacuuucaugcgcauggcuuggggaggguccuacaucgcacuggauucaggucacggcaacugggacuguauaaugaccaguuaccaguauuugauuauccagaauacaacuugggaagaucauugccaguuuagccgaccgucucccauuggguaccucggacuguuaucccaacguaccagagacaucuauaucucaaggcggcugcucggcacauucaccuggacgcuuagcgauagugaggguaacgccacuccugggggauacugucugacacgcuggauguugauugaagcugagcuaaagugcuuuggcaauaccgccguggcgaaauguaacgagaagcacgacgaagaguucugcgauaugcugagacucuuugacuucaauaaacaggcaauaucuaggcugcgguccgaagcccagaugagcauccagcuuauuaacaaggcuguaaaugcccugaucaacgaucaauugauaaugaaaaaucaccuccgcgacauuaugggcaucccauauugcaacuacucgaaguauugguaccugaaucauacuguuacagggcgaaccucuuuacccaaguguuggcugguguccaacggaucauaccuaaaugagacgcacuucagugacgauaucgaacagcaggcagacaacaugauuaccgagaugcuccaaaaagaguauauggauagacaggguaagacaccucugggccuugucgacuuguuuguguucagcacuuccuuuuaccugaucucuauuuuccuccaucuggugaaaauaccaacccacaggcauaucgucgggaagcccugcccuaaaccacaccggcuuaaucguaugggaauuuguagcugcggccuguauaagcagccggguguucccgugaaauggaagcgcuga

SEQ ID NO: 1522 - RNA, 1476 nt, Artificial Sequence
  derived and/or modified CDS sequence (opt3) from Lassa virus__AHC95559__GPC
augggccagaucauuaccuucuuucaagaggugccccacgucauagaagagguuaugaacaucgugcugauugcccucagcauccuugcuguacugaagggguuguacaauauugcaacaugcggauuaaucggucuggugacuuuccuacuccuguguggcagauccuguucuucaagucuuuauaaaggggucuacgaacugcagagcuuggaccucaacauggagacgcugaauaugaccaugccucuguccugcacaaagaacaauucucaucacuauauaagggugggaaacgaaacuggccucgaguuaacccugacaaauaccucgcuuaucaaccauaaauuuugcaauuugucagaugcccacaagaaaaaccuguacgaccaugcgcuaaugagcauuaucaguacuuuccaccucuccauuccaaauuuuaaccaguaugaggcuaugucuugugauuucaauggugggaagaucagcguucaguacaaccugucccacgccuaugcaauagacgccgcuucacauugcggaacaguggcaaauggcguccuucaaaccuuuaugcggauggccuggggcgggaguuacauugcucuggauagcggacacgguaacugggacuguaucaugacgucuuaccaguauuugauuauccagaacacuaccugggaagaucauugccaguucucccgcccgucacccaucggcuaccucgggcuguuaagccaacgaacacgugacauuuauauaaguagaaggcugcucggaacuuuuaccuggacacuuucugauuccgagggcaaugccaccccugguggguacugucugacgcgguggauguugaucgaagcggagcuaaagugcuucggaaacacugcaguggccaaauguaaugagaagcacgacgaagaguuuugcgauaugcugcgccucuucgacuuuaacaaacaggcuauuagcagacugaagucggaagcccagaugucuauccagcuuauaaauaaagcaguaaacgcucugauuaaugaucaauugaucaugaagaaccaccucagggacaucaugggcauuccauauugcaauuacuccaaguauugguaccugaaccauacaguuaccggcaaaacuucauuacccaaguguuggcuggugaguaaugggagcuaccuaaacgagacacacuucuccgacgauaucgaacagcaggccgacaauaugauuaccgagaugcuccaaaaagaguauauggaacggcagggaaagacgccucugggucuugucgauuuguucguguuuucuaccagcuucuaccugauaucaaucuuucuccaucuggugaaaauuccaacacaccgccauaucgucggcaagcccugcccuaaaccacaccgacuuaaccacauggggaucuguaguugcggacuguauaagcagccgggcguucccgugaaguggaaaagauga

SEQ ID NO: 1523 - RNA, 1476 nt, Artificial Sequence
  derived and/or modified CDS sequence (opt3) from Lassa virus__AIT17126__GPC
augggccagaucgugaccuucuuucaagaggucccccacguuauugaagaggugaugaacauaguacugaucgcccucagcauucuugcugugcugaagggguuguacaauuucgcaacaugcggauuagucggucugcuaacuuuucuccugcuuuguggcagauccugcacgaccgggcuguauaaaggaguguacgaauugcagacacucgagcugaacauggaaacucugaauaugaccaugccucucucuuguacaaagaacaauucacaucacuauaucaugguuggcaacgagaccgguuuagagcugacucuuacaaauaccaguauuaucaaccauaaauucugcaauuugagcgacgcccacaagaaaaaccuguacgaucaugcgcuaauguccauaaucucuacguuucaccucucgauuccaaauuucaaccaguaugaagcuaugucaugugacuuuaaugggggaaagaucagcgugcaguacaaccugagucacuccuaugccggcgaugcagccgaccauugcggcacugucgcuaauggggugcuucaaaccuucaugaggauggcauggggagguucuuacauugcccuggauagcggccgggggcgcugggacuguaucaugacauccuaccaguauuugauaauucagaacacuaccugggaggaucacugccaguuuucacgaccgagucccaucggauaccucggccuguuaagccaacguacaagagacauuuauaucucuaggcggcugcucgguaccuucacguggacucuuuccgauucagaagggaaggacacaccuggaggcuacugucugacccgcuggauguugaucgaggcugagcuaaaaugcuuuggcaacacugccguagcgaaguguaaugaaaaacaugaugaggaguucugcgacaugcugagacucuuugauuucaacaagcaggcaauucagaggcugaaagccgaagcucagaugagcauacaacuuaucaauaaggccguuaacgcacugauuaaugaccaguuggugaugaagaaccaccuccgggacaucauggggauaccauauugcaauuacagucgcuauugguaccugaaccacacaaccacgggacgaaccucuuuacccaaauguuggcuggucuccaaugguagcuaccuaaacgaaacacauuucucggaugacauugagcagcaagcugauaauaugaucacugagaugcuccagaaggaauauauggagagacagggcaaaaccccucuggggcuuguggacuuguuuguguucucuacauccuuuuaccugaucucaauuuuccuccaccuggucaagaucccaacucauaggcacauuguuggaaaaaguugccccaagccucaucggcuuaaccacaugggcauauguagcugcggucuguauaaacagccaggggugccgguaaaguggaagcguuga

SEQ ID NO: 1524 - RNA, 1476 nt, Artificial Sequence
  derived and/or modified CDS sequence (opt3) from Lassa virus__AIT17130__GPC
augggccagaucgugaccuucuuucaagaggucccccacguuauugaagaggugaugaacauaguacugaucgcccucagcauucuugcugugcugaagggguuguacaauuucgcaacaugcggauuugucgguuuagugacuuuccugcuacucuguggcagauccugcacgaccucucuguauaaagggguuuacgaacuucagacacuggaguugaacauggaaacucucaauaugaccaugccucugucauguacaaagaacaauagucaucacuauaucagggugggaaacgacaccggccuggagcucacuuuaacaaauaccagcauuaucaaccauaaauuuugcaaucuguccgaugcccacaagaaaaaccuuuacgaccaugcguugaugucuauaaucucgacguuccaccugucaauuccaaauuuuaaccaguaugaggcuaugagcugugauuucaauggugggaagaucaguguccaguacaaccuaucccacucuuaugccguggacgcagccagccauugcggaacuauugcuaauggcguacuccaaaccuuuaugcggauggcauggggcggguccuacaucgcccuggauucaggacgcgaccgaugggauuguauaaugacaaguuaccaguaucuuauuauccagaacacuaccugggaagaccacugccaguucagccguccgucucccauugguuaccugggcuugcucucccaaagaacaagggauaucuauaucucacggcgccuguuagggaccuuuacguggacucugagcgacagugagggaaaggauacaccuggcgguuacugucucaccagauggaugcuuauugaagcugagcugaaaugcuucgggaacacugccguugcgaaguguaaugagaaacaugacgaagaguuuugcgauauguugaggcuauucgacuucaacaagcaggcaauacagcggcugaaagccgaagcucagaugucuauccaacucauuaauaaggccgugaacgcacugaucaaugaccagcuuauaaugaagaaccacuugcgcgauauuaugggaaucccauauugcaauuacuccaaauauugguacuugaaccacacaaccacgggcaagaccagccuccccaaauguuggcuggucucgaauggcucuuacuuaaacgagacacauuuuuccgacgauaucgaacagcaagcugacaauaugauuacugagaugcugcagaaggaguauauggaacgacaggggaaaaccccucuaggacucguggaucuguucguguuuucaacaaguuucuaccuuaucagcauuuuucugcaccuggucaagauaccaacucauagacacaucguugguaaauccugccccaagccucauaggcucaaccacaugggcauuuguucuugcgggcuguauaagcagccaggagugccgguaaaauggaagcgguga

SEQ ID NO: 1525 - RNA, 1476 nt, Artificial Sequence
  derived and/or modified CDS sequence (opt3) from Lassa virus__AIT17134__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccggagaugcagccaaucauugcggcacuguggcuaacggcguacugcaaaccuucaugaggauggcauggggagggagcuacauugcccuugacuccggucggggccgcugggauuguaucaugacaucauaccaguaucugauaauucagaacacuaccugggaggaccacugccaguuuagucgaccgagccccaucggguacuugggacuccugucucaacguacaagagauauuuauaucuccaggcgguuacugggcaccuucacguggacucucucagacagcgaagguaaggauacaccugggggauacugucuuacccgcuggaugcugaucgaggcugaguugaaaugcuuuggcaauacugccguugcgaaguguaacgaaaaacaugacgaggaguucugcgauaugcuaagacuguuugacuucaauaagcaggcaauucagaggcucaaagccgaagcucagaugaguauacaacugaucaacaaggccgugaaugcacuuauuaacgaucagcugaucaugaagaaucacuugcgggacauaaugggcauuccauauugcaacuacucuaaauauugguaccucaaucacacaaccacggggaagaccucccugcccaaauguugguuagucagcaacggaucguaccugaaugaaacacauuucucugacgauaucgagcagcaagcugacaacaugaucacugagaugcuacagaaggaauauauggagcgccaggguaaaaccccucucggccugguggaucuuuuuguguucuccacaucauuuuacuugauuaguaucuuccugcaccucgucaagauuccaacucaucgacacauaguugggaaaagcugccccaagccucauagacugaaucacaugggaaucuguuccugcggccuuuauaagcagccaggugugccgguaaaauggaagagguga

SEQ ID NO: 1526 - RNA, 1476 nt, Artificial Sequence
  derived and/or modified CDS sequence (opt3) from Lassa virus__AIT17138__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcuugauuaaccauaaauuuugcaaucuguccgacgcccacaagaaaaaccuauacgaucaugcgcucaugucuaucauaucgacguuccaccugucaaucccaaauuuuaaccaguaugaagcuaugagcugugacuucaauggugggaagauuaguguccaguacaaccuuucccacucuuaugccguggaugcagccagccauugcggaacuguagcuaauggcguucugcaaaccuuuaugaggauggcauggggcggguccuacaucgccuuggacucaggacgggguggcugggauuguauuaugacaaguuaccaguaucucaucauacagaacacuaccugggaggaccacugccaguucagccgcccgucucccauuggguaccugggauuacugucccaacgaacacgugauaucuauauuucaagaaggcuccuuggcaccuuuacguggacucugagcgacagugaagguaaggauacaccugggggauacuguuugacccgguggaugcuaaucgaggcugagcugaaaugcuucggcaacacugccguggcgaaguguaaugaaaaacaugacgaggaauuuugcgauaugcuccgccuguucgacuuuaacaagcaggcaauccagagacuuaaagccgaggcucagaugucuauucaacugauaaauaaggccgucaacgcauugaucaaugaucagcucauuaugaagaaccaccugagggacaucaugggcauaccauauugcaauuacuccaaauauugguacuuaaaccacacaaccacggggcggaccagccugccccgcuguuggcuagugucgaauggaucuuaccucaacgaaacacauuucuccgacgauauugagcagcaagcugacaauaugaucacugagaugcugcagaaggaauauauggagcgacaggguaaaaccccucuuggcuugguggaucuguucgucuuuucaacaaguuucuaccucaucagcauuuuucugcaccuuguuaagaucccaacucauagacacauuguggggaaauccugccccaagccucauaggcugaaccacaugggaauauguucuugcggcuuguauaaacagccagguguaccggugaaguggaagcgguga

SEQ ID NO: 1527 - RNA, 1476 nt, Artificial Sequence
  derived and/or modified CDS sequence (opt3) from Lassa virus__AIT17142__GPC
augggccagaucgugaccuucuuucaagaggucccccacguuauugaagaggugaugaacauaguacugaucgcccucagcgugcuugcuguccugaagggguuguacaauuucgcaacaugcggaauuguggguuuaguuacuuuucugcuacucuguggcagauccugcacgaccucucuguauaaagggguguacgaacuucagacacuggaguugaacauggaaacucucaauaugaccaugccucugucauguacaaagaacaauagucaucacuauaucauggucggaaacgacaccggccuggagcucacuuuaacaaauaccagcauuaucaaccauaaauucugcaaucuguccgaugcccacaagaaaaaccuuuacgaccaugcguugaugucuauaaucucgacguuucaccugucaauuccaaauuucaaccaguaugaggcuaugagcugugauuuuaauggugggaagaucagugugcaguacaaccuaucccacucuuaugccggagacgcagccgaucauugcggcacuguagcuaauggcguucuccaaaccuucaugaggauggcauggggagggagcuacauugcccuggacuccggucggggccgcugggauuguaucaugacaucauaccaguaucuuauaauucagaacacuaccugggaagaccacugccaguuuagucgaccgagccccaucggguaccugggauugcucucucaacguacaagagauauuuauaucuccaggcggcuguuaggcaccuucacguggacucugucagacagcgaggguaaggauacaccugggggauacugucucacccgcuggaugcuuaucgaagcugagcugaaaugcuuuggcaacacugccguggcgaaguguaaugagaaacaugacgaagaguucugcgauauguugagacuauuugacuucaacaagcaggcaauucagaggcugaaagccgaagcucagaugaguauacaacucaucaauaaggccgucaacgcacugauuaaugaccagcuuaucaugaagaaccaucugcgggauauaaugggcauuccauauugcaauuacucuaaauauugguacuugaaccacacaaccacggggaagaccucccuccccaaauguuggcuggugagcaauggaucguacuuaaacgagacacacuucucugacgauaucgaacagcaagcugacaauaugaucacugagaugcugcagaaggaguauauggaacgccaggguaaaaccccucuaggccucguggaucuguuugucuucuccacaucauuuuaccuuauuaguaucuucuugcaccugguuaagauuccaacucaucgacacauaguggggaaacccugcccuaagccacauagacucaaccacaugggaaucuguagcugcggccuguauaagcagccggguguacccgugaaauggaagagguga

SEQ ID NO: 1528 - RNA, 1476 nt, Artificial Sequence
  derived and/or modified CDS sequence (opt3) from Lassa virus__AIT17146__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucaaccauaaauuuugcaauuuguccgacgcccacaagaaaaaccuguacgaucaugcgcuaaugucuauaaucucgacguuccaccucucaauuccaaauuuuaaccaguaugaagcuaugagcugugacuucaauggugggaagaucaguguccaguacaaccugucccacucuuaugccggagaugcagccaaucauugcggcacuguggcuaacggcguacuucaaaccuuuaugaggauggcauggggagggagcuacauugcccuggacuccggucggggccgcugggauuguaucaugacaucauaccaguauuugauaauucagaacacuaccugggaggaccacugcaguuucagccgaccgucucccaucggguaccucggacuguuaucccagcguacaagagauauuuauaucucaaggcggcugcucggcaccuuuacguggacucuuagcgacagugaagguaaggauacaccugggggauacugucugacccgcuggauguugaucgaggcugagcuaaaaugcuucggcaauacugccguugcgaaguguaacgaaaaacaugacgaggaauuuugcgauaugcugagacucuucgacuuuaauaagcaagcaauucagaggcugaaagccgaggcucagaugucuauacagcuuaucaacaaggccgugaaugcacugauuaacgaucaauugaucaugaagaaucaccuccgggacauaaugggcauuccauauugcaacuacuccaaauauugguaccugaaucacacaaccacggggaagaccagcuuacccaaauguuggcuggucucgaacggaucuuaccuaaaugaaacacauuucuccgacgauaucgagcagcaggcugacaacaugaucacugagaugcuccaaaaggaauauauggagcgccaggguaaaaccccucugggccuuguggauuuguucguguuuucaacaaguuucuaccugauuagcaucuuucuccaccuggucaagauuccaacucaucgacacauaguugggaaauccugccccaagccucauagacuuaaucacaugggaaucuguucuugcggcuucuauaagcagccaggugugccgguaaaauggaagagguga

SEQ ID NO: 1529 - RNA, 1476 nt, Artificial Sequence
  derived and/or modified CDS sequence (opt3) from Lassa virus__AIT17154__GPC
augggccagaucgugaccuucuuucaagaggucccccacguuauugaagaggugaugaacauaguacugaucgcccucagcauucuugcugugcugaagggguuguacaauuucgcaacaugcggaaucgucgguuuaguguccuuucugcuacucuguggcagaucuugcacuacgucacuguauaaagggguuuacgaacuucagacccuggaguugaacauggaaacacucaauaugacuaugccucugaguuguaccaagaacaauagccaucacuauauuauggugggaaacgagacaggccuggagcucaccuuaacuaauacauccaucauaaaccauaaauucugcaaucugucugacgcccacaagaaaaaccuuuacgaucaugcguugaugucgaucauuucaaccuuucaccugagcaucccaaauuucaaccaguaugaagcuaugaguugugacuuuaauggugggaagauuuccguccaguacaaccuaucucacagcuaugccggagaugcagccaaucauugcggcacgaucgcuaacggcgugcuccaaacuuucaugaggauggcauggggaggguccuacauagcccuggacucaggucgggaucgcugggacuguauuaugaccaguuaccaguaucuuaucauucagaacacaacuugggaggaucacugccaguuuagccgaccgucucccaucggcuaccugggguugcucucccaacguaccagagacaucuauauuucaaggcggcuguuaggaacauucaccuggacgcugagcgauagugaaggcaaggacacuccugguggguacugucucacacgcuggaugcuuauagaggcugagcugaaaugcuuuggaaauaccgccguagcgaaguguaacgaaaaacaugaugaggaguucugcgacauguugagacuauuugauuucaauaagcaggcaauccagaggcugaaagccgaagcucagaugucuauucaacucaucaacaaggccguuaaugcacugauaaacgaccagcuuauuaugaagaaucaucugcgggacaucaugggcaucccauauugcaacuacuccaaauauugguacuugaaucacacuacaaccggcaagacgagccuccccaaauguuggcuggugucgaacgggucuuacuuaaaugaaacccacuucuccgaugacauugagcagcaagcugauaacaugaucacagagaugcugcagaaggaauauauggagcgccagggaaaaacuccucuaggucucgucgaccuguuuguguucucaaccaguuuuuaccuuauuagcauauucuugcaccuggugaagaucccaacacaucgacacgucguuggcaaauccugccccaagccucauagacucaaucacauggggauuuguucuugcggacuguauggccagccaggugugccgguaaaguggaaaagguga

SEQ ID NO: 1530 - RNA, 1476 nt, Artificial Sequence
  derived and/or modified CDS sequence (opt3) from Lassa virus__AIT17158__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccggagaugcagccaaucauugcggcacuguggcuaacggcguacugcaaaccuucaugaggauggcauggggagggagcuacauugcccuugacuccggucgggaucgcugggacuguaucaugacaucauaccaguaucugauaauucagaacacuaccugggaggaucacugccaguuuagucgaccgagccccaucggcuacuuggggcuccugucucaacguacaagagacauuuauaucuccaggcgguuacugggaaccuucacguggacucucucagauagcgaaggcaaggacacaccugguggguacugucuuacccgcuggaugcugaucgaggcugaguugaaaugcuuuggaaauacugccguugcgaaguguaacgaaaaacaugaugaggaguucugcgacaugcuaagacuguuugauuucaauaagcaggcaauucagaggcucaaagccgaagcucagaugaguauacaacugaucaacaaggccgugaaugcacuuauuaacgaccagcugaucaugaagaaucacuugcgggacauaaugggcauuccauauugcaacuacucuaaauauugguaccucaaucacacaaccacgggcaagaccucccugcccaaauguugguuagucagcaacgggucguaccugaaugaaacacauuucucugaugacaucgagcagcaagcugauaacaugaucacugagaugcuacagaaggaauauauggagcgccagggaaaaaccccucucggucugguggaccuuuuuguguucuccacaucauuuuacuugauuaguaucuuccugcaccucgucaagauuccaacucaucgacacauaguuggcaaaagcugccccaagccucauagacugaaucacauggggaucuguuccugcggacuuuauaagcagccaggcgugccgguaaaauggaagagguga

SEQ ID NO: 1531 - RNA, 1476 nt, Artificial Sequence
  derived and/or modified CDS sequence (opt3) from Lassa virus__AIT17164__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgucuucacuuuauaaagggguuuacgaacugcagaccuuggagcucaacauggaaacacugaauaugacuaugccucugaguuguaccaagaacaauagccaucacuauaucagggugggaaacgagacaggccucgaguuaacccugacuaauacauccauuaucgaccauaaauucugcaaccuuucugaugcccacaagaaaaauuuguacgaccaugcgcugaugucgauaaucucaaccuuucaccuaagcauuccaaacuucaaucaguaugaagcuaugaguugugauuuuaacggugggaagaucuccguccaguacaaucucucucacagcuaugccggagacgcagccaagcauugcggcacgguggcuaacggcguacugcaaacuuucaugcggauggcauggggaggguccuacauugcccuugauucaggucacggcaauugggacuguaucaugaccaguuaccaguaucugauaauucagaacacaacuugggaggaucauugccaguuuagccgcccgucucccaucggguacuugggacuccugucccaacgaacccgugacauuuauaucucaagaagguuacugggcacauucaccuggacgcucagcgauagugaagguaacgacgcuccugggggauacugucuuacucgguggaugcugauccaggccgaguugaaaugcuuuggcaauacagcgguugcaaaguguaacgagaaacacgaugaagaguucugcgacaugcuacgccuguuugauuucaauaagcaggccauucagagacucaaagcugaagcccaaaugucuauacagcugaucaacaaggcagugaaugcucuuauuaacgaccagcugaucaugaagaaucacuugagggacauaaugggcauuccauauugcaacuacuccaaauauugguaccucaaucauaccacuacagggcggaccagccugccccgcuguugguuagucucgaacggaucuuaccugaaugagacgcacuucuccgaugacaucgaacaacaggccgauaacaugaucaccgagaugcuacagaaggaguauauggaacgacaggguaaaacaccucucggccugguggaccuuuuuguguucucaaccaguuuuuacuugauuagcaucuuccugcaucucgucaagauuccaacucacagacauauaguugggaaauccugccccaagccucacaggcugaaucacaugggaaucuguucuugcggccuuuuuaaacaaccaggugugccgguaaaguggaagcgguga

SEQ ID NO: 1532 - RNA, 1476 nt, Artificial Sequence
  derived and/or modified CDS sequence (opt3) from Lassa virus__AIT17168__GPC
augggccagaucgugaccuucuuucaagaggucccccacguuauugaagaggugaugaacauaguacugaucgcccucagcauucuugcugugcugaagggguuguacaauuucgcaacaugcggauuagucggucugcuaacuuuucuccugcuuuguggcagauccugcacggccucuagguauaaagggguguacgaacugcagaccuuggagcucaacauggaaacacugaauaugacuaugccucugucauguaccaagaacaauagucaucacuauaucaugguuggaaacgagacaggccucgaguuaacccugacuaauacaagcauuaucaaccauaaauucugcaaucuuuccgacgcgcacaagaaaaacuuguacgaucaugcucugaugucuauaaucucgaccuuucaccuaucaauuccaaauuucaaccaguaugaagccaugagcugugacuuuaauggugggaagaucagugugcaguacaaccucucccacucuuaugcaggagaugccgcuaaucauugcggcacggucgcaaacggcgugcugcaaacuuucaugcggauggccuggggagggagcuacauugcucuugacuccggucacggcucaugggauuguaucaugaccaguuaccaguaucugauaauucagaacacaacuugggaggaccauugccaguuuagccgcccgucucccaucggguacuugggacuccugucccaacgaacccgugauauuuauaucucaagaagguuacugggcacauucaccuggacgcucagcgacagugaagguaaggauacuccugggggauacugucuuacacgguggaugcugaucgaggccgaguugaaaugcuuuggcaauaccgcgguagcaaaguguaacgaaaaacacgacgaggaguucugcgauaugcuacgccuguuugacuucaauaagcaggccauucagagacucaaagcugaagcccagaugucuauacaacugaucaacaaggcaguuaaugcucuuauuaacgaucagcugaucaugaagaaucacuugagggacauaaugggcauuccauauugcaacuacuccaaauauugguaccucaaucauacuacaaccgggaagacgagccugcccaaauguugguuagugucgaacggaucuuaccugaaugaaacccacuucuccgacgauaucgagcagcaagccgacaacaugaucacagagaugcuacagaaggaauauauggagcggcaggguaaaacuccucucggccuggucgaucuuuuuguguucucaaccaguuuuuacuugauuagcaucuuccugcaucucgugaagauuccaacacaccgccauauagucgggaaauccugccccaagccucaccgacugaaucacaugggaaucuguucuugcggccuuuauaagcagccagguguuccggugaaauggaagagauga

SEQ ID NO: 1533 - RNA, 1476 nt, Artificial Sequence
  derived and/or modified CDS sequence (opt3) from Lassa virus__AIT17172__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccggagaugcagccaaucauugcggcacuguggcuaacggcguacugcaaaccuucaugaggauggcauggggagggagcuacauugcccuugacuccggucggggccgcugggauuguaucaugacaucauaccaguaucugauaauucagaacacuaccugggaggaccacugccaguuuagucgaccgagccccaucggguacuugggacuccugucucaacguacaagagauauuuauaucuccaggcgguuacugggcaccuucacguggacucucucagacagcgaagguaaggauacaccugggggauacugucuuacccgcuggaugcugaucgaggcugaguugaaaugcuuuggcaauacugccguugcgaaguguaacgaaaaacaugacgaggaguucugcgauaugcuaagacuguuugacuucaauaagcaggcaauucagaggcucaaagccgaagcucagaugaguauacaacugaucaacaaggccgugaaugcacuuauuaacgaucagcugaucaugaagaaucacuugcgggacauaaugggcauuccauauugcaacuacucuaaauauugguaccucaaucacacaaccacggggaagaccucccugcccaaauguugguuagucagcaacggaucguaccugaaugaaacacauuucucugacgauaucgagcagcaagcugacaacaugaucacugagaugcuacagaaggaauauauggagcgccaggguaaaaccccucucggccugguggaucuuuuuguguucuccacaucauuuuacuugauuaguaucuuccugcaccucgucaagauuccaacucaucgacacauaguugggaaacccugcccuagaccacauaggcugaaucacaugggaaucuguagcugcggccuuuauaagcagccgggugugcccguaaaguggaaacgguga

SEQ ID NO: 1534 - RNA, 1476 nt, Artificial Sequence
  derived and/or modified CDS sequence (opt3) from Lassa virus__AIT17176__GPC
augggccagaucgugaccuucuuucaagaggucccccacguuauugaagaggugaugaacauaguacugaucgcccucagccuucuggcuguguugaagggguuauacaaugucgcaacaugcggacugauuggucuaaucacuuuccuccugcuuuguggcagauccugcacgaccaaccuguauaaagggguguacgaauugcaggcccucgagcugaauauggaaacacugaacaugacuaugccucucucuuguaccaagaauaacucacaucacuauauuaugguuggaaaugagacaggcuuagagcugacccuuacuaacacaaguaucauaaaucauaaauuuugcaacuugagcgacgcgcacaagaaaaaucuguacgaucaugcucuaauguccaucauuucuaccuuccaccucucgaucccaaacuuuaaucaguaugaagccaugucaugugacuucaacggugggaggauuagcgugcaguacaaucugagucacuccuaugcaggagaugccgcuucucauugcggcacgaucgcaaacggcguccuucaaacuuuuaugcggauggccuggggagggagcuacauagcucuggacuccggucacggcgggugggauuguauuaugaccucauaccaguauuugaucauucagaacacaacuugggaggaccauugccaguucagucgcccgagccccaucggauaccucggccuguuaucucaacgaacccgugauaucuauauuuccagaaggcugcucgguacauuuaccuggacgcuuucagacagcgaagggaaggauacuccuggaggcuacugucugacacgguggauguugauagaggccgagcuaaagugcuucggcaauaccgcgguggcaaaauguaacgaaaagcacgacgaggaauuuugcgauaugcugcgccucuucgacuuuaauaaacaggccauccagagacugaaggcugaggcccagaugaguauucaacuuaucaacaaagcaguaaaugcucugauaaacgaucaguugauuaugaagaaucaccucagggacaucauggggaucccauauugcaacuacucuaaguauugguaccugaaucauacuguuacaggaaaaaccuccuuacccaaguguuggcuggugagcaacgguucguaccuaaaugaaacgcacuucucugacgauauugagcagcaagccgacaacaugaucaccgagaugcuccagaaagaauauauggagcggcagggcaagacaccucuggggcuugucgauuuguucguguuuuccacuucauucuaccugauuaguauauuucuccaucuggugaaaaucccaacccaccgccaugucguuggaaagcccugcccuaaaccacaccgacuuaaucacaugggcauuuguagcugcggucuguauaagcagccgggggugcccguaagauggaagagguga

SEQ ID NO: 1535 - RNA, 1476 nt, Artificial Sequence
  derived and/or modified CDS sequence (opt3) from Lassa virus__AIT17180__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuacuccuguguggcagauccugcacgaccacacuuuauaaagggguuuacgaacugcagacuuuggagcucaacauggaaacccugaauaugacaaugccucugucuuguaccaagaacaauucacaucacuauauuagggugggaaacgagacuggccucgaguuaacacugaccaauacgaguaucauaaaccauaaauuuugcaaucuuagcgacgcccacaagaaaaacuuguacgaucaugcgcugauguccaucauuucuacuuuccaccuaucgaucccaaauuuuaaccaguaugaagcuaugucaugugacuucaauggugggaagauuagcguccaguacaaccucagucacuccuaugccggagaugcagccaaucauugcggcaccguggcuaacggcguacugcaaacauuuaugcggauggcauggggagggucuuacaucgcccuugacagcggucgcggcaacugggauuguauaaugacuuccuaccaguaucugauuauccagaauaccacaugggacgaucacugccaguucucacgaccgagucccauuggguacuugggacuccugagccaacguaccagagacguuuauaucucuaggcgguuacugggcacguuuacuuggacacucuccgauucagaggguaaggacaccccugggggauacugucuuacucgcuggaugcugaucgaagcugaguugaaaugcuucggcaacacagccguggcgaaguguaaugagaaacaugaugaagaguuuugcgacaugcuaagacuguucgauuuuaacaagcaggcaauucagaggcucaaagccgaagcucagaugagcauacaacugaucaauaaggccgucaacgcacuuauuaaugaccagcugaucaugaagaaccacuugcgggacauaaugggcauuccauauugcaauuacaguaaauauugguaccucaacaauaccgcuacggggaagaccucucugcccaaauguugguuaaucuccaacggaagcuaccugaaugagacacacuucucggaugacaucgaacaggaggccgauaacaugauuacugagaugcuacaaaaggaauauauggagcgccaggguaaaaccccucucggccugguggaccuuuucguguuuucuacauccuucuacuugaucucaauuuuucugcaucucgucaagauaccaacucaccgacauaucguugggaaaaguugccccaagccucacagacugaaucauaugggaauuuguagcugcggccuuuauaagcagccaggugugccgguaagguggaaacgguga

SEQ ID NO: 1536 - RNA, 1476 nt, Artificial Sequence
  derived and/or modified CDS sequence (opt3) from Lassa virus__AIT17184__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuacuccuguguggcagauccugcacgaccacacuuuauaaagggguuuacgaacugcaggccuuggagcucaacauggaaacucugaauaugaccaugccucugucuuguacaaagaacaauucacaucacuauauuagggugggaaacgagaccggccucgaguuaacucugacaaauaccaguaucauagaccauaaauuuugcaaccuuagcgaugcgcacaagaaaaauuuguacgaccaugcucugauguccaucauuucuacguuccaccuaucgaucccaaacuuuaaucaguaugaagccaugucaugugauuucaacggugggaagauuagcguccaguacaaucucagucacuccuaugcaggagacgccgcuaaccauugcggcacuguggcaaauggcguacugcaaaccuuuaugcggauggccuggggagggucuuacaucgcucuugauagcggucgcaacggcugggacuguauaaugacauccuaccaguaucugauuauccagaacacuaccugggaugaccacugccaguucucacgaccgagucccauuggguacuugggacuccugagccaacguacaagagauaucuauaucucuaggcgguuacugggcaccuuuacguggacucucuccgacucagaggguaaggauacaccugggggauacugucuuacccgcuggaugcugauugaagccgaguugaaaugcuucggcaauacugcgguugcaaaguguaacgagaaacaugacgaagaguuuugcgauaugcuaagacuguucgacuuuaauaagcaggccauaaggcggcucaaagcugaagcccagaugagcauccagcugauuaacaaggcagugaaugcucuuaucaacgaccaacugauaaugaagaaucacuugcgcgauauuaugggcaucccauauugcaacuacaguaaauauugguaccucaauaacacagccaccgggaagacgucucugccccgauguugguuagucuccaauggaagcuaccugaacgagacccacuucucggacgauaucgaacagcaggcggacaauaugauuacagagaugcuacaaagagaguauauggaaaggcaggguaaaacuccucucggccugguggaucuuuucguguuuucuaccuccuucuacuugaucucaauuuuucugcaucucgucaagauaccaacacaccggcauaucguugggaaacccugcccuaagccacaccgucugaaccauaugggaauuuguaguugcggccuuuauaaacagccgggugugcccguaaaguggaagcgcuga

SEQ ID NO: 1537 - RNA, 1476 nt, Artificial Sequence
  derived and/or modified CDS sequence (opt3) from Lassa virus__AIT17188__GPC
augggccagaucgugaccuucuuucaagaggucccccacguuauugaagaggugaugaacauaguacugaucgcccucagcauucuugcugugcugaagggguuguacaauuucgcaacaugcggauuugucgguuuaguguccuuccugcuacucuguggcagaucuugcacuacgucacuguauaaagggguuuacgaacuucagacccuggaguugaacauggaaacacucaauaugacuaugccucugaguuguaccaagaacaauagccaucacuauaucauggugggaaacgagacaggccuggagcucaccuuaacuaauacauccauuaucaaccauaaauuuugcaaucugucugacgcccacaagaaaaaccuuuacgaucaugcguugaugucgauaaucucaaccuuccaccugagcauuccaaauuuuaaccaguaugaagcuaugaguugugacuucaauggugggaagaucuccguccaguacaaccuaucucacagcuaugccguggaugcagccaaucauugcggaacgguagcuaacggcguucuccaaacuuuuaugaggauggcauggggcggguccuacauugcccuggacucaggacacgguaguugggauuguaucaugaccagcuaccaguaucuuauaauucagaacacaacuugggaggaccauugccaguucucucggccgucccccaucggcuaccugggguugcucucacaacgcacccgagauauuuauaucagccguagacuguuaggaacauuuaccuggacgcugagugacucugaaggcaaggauacuccugguggguacugucucacaagguggaugcuuaucgaggcugagcugaaaugcuucggaaauaccgccguggcgaaguguaacgaaaaacacgacgaggaauuuugcgauauguugcggcuauucgacuucaauaagcaggcaauucagcgccugagagccgaggcucagauguccauacaacucaucaacaaagccgucaaugcacugauuaacgaucagcuuaucaugaagaaucaccugagggacauaaugggcauuccauauugcaacuacagcaaguauugguacuugaaucauacuacaaccggccggacgucgcuccccaaauguuggcuggugucuaacggguccuacuuaaaugaaacccacuuuucagacgauaucgagcagcaagcugacaacaugaucacagagaugcugcagaaggaauauauggagcgccagggaaaaacuccucuaggucucguggaucuguucgucuuuaguaccagcuucuaccuuauuuccaucuuuuugcaucugguuaagauuccaacacaccgacauauagugggcaaaucuugccccaagccucacagacucaaucacauggggaucuguagcugcggacuguauggccagccagguguaccggugaaauggaagagguga

SEQ ID NO: 1538 - RNA, 1476 nt, Artificial Sequence
  derived and/or modified CDS sequence (opt3) from Lassa virus__AIT17192__GPC
augggccagaucgugaccuucuuucaagaggucccccacguuauugaagaggugaugaacauaguacugaucgcccucagcauucuugcugugcugaagggguuguacaauuucgcaacaugcggauuuaucgguuuagucuccuuccugcuacucuguggcagaucuugcacuacgucacuguauaaagggguguacgaacuucagacccuggaguugaacauggaaacacucaauaugacuaugccucugaguuguaccaagaacaauagccaucacuauauuaugguuggaaacgagacaggccuggagcucaccuuaacuaauacauccaucauaaaccauaaauuuugcaaucugucugacgcccacaagaaaaaccuuuacgaucaugcguugaugucgaucauuucaaccuuccaccugagcaucccaaauuuuaaccaguucgaagcuaugaguugugacuuuaauggugggaagauuuccgugcaguauaaccuaucucacagcuacgccgucgaugcagccaaucauugcggaacgguggcuaacggcguacuccaaacuuucaugaggauggcauggggcggguccuauaucgcccuggacucaggacacgguaguugggauuguauaaugaccagcuaccaguaccuuauuauccagaacacaacuugggaggaccauugccaguuuucucggccgucccccauuggcuaucugggguugcucucacaacgcacccgagauaucuacaucagccguagacuguuaggaacauucaccuggacgcugagugacucugaaggcaaggauacuccugguggguauugucucacaagguggaugcuuauugaggcugagcugaaaugcuuuggaaauaccgccguugcgaaguguaacgaaaaacacgacgaggaguucugcgauauguugcggcuauucgacuuuaauaagcaggcaauacagcgccugaaagccgaagcucagauguccauccaacucauuaacaaggccgugaaugcacugaucaacgaucagcuuauaaugaagaaucaccugagagacauuaugggcaucccauacugcaacuauagcaaauacugguauuugaaucauacuacaaccggcaggacgucgcuccccaaguguuggcuggucucuaacggguccuacuuaaaugaaacccacuucucagacgauaucgagcagcaagcugacaacaugauuacagagaugcugcagaaagaauacauggagcggcagggaaagacuccucuaggucucguggaucuguuuguguucaguaccagcuuuuaucuuaucuccauuuucuugcaucuggucaaaauaccaacacaccgccauaucguuggcaagucuugccccaaaccucaccgacucaaucacauggggauuuguagcugcggacuguacggccagccaggugugccgguaaaguggaagagauga

SEQ ID NO: 1539 - RNA, 1476 nt, Artificial Sequence
  derived and/or modified CDS sequence (opt3) from Lassa virus__AIT17196__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucaaccauaaauuuugcaauuuguccgacgcccacaagaaaaaccuguacgaucaugcgcuaaugucuauaaucucgacguuccaccucucaauuccaaauuuuaaccaguaugaagcuaugagcugugacuucaauggugggaagaucaguguccaguacaaccugucccacucuuaugccggagaugcagccaaucauugcggcacuguggcuaacggcguacuucaaaccuuuaugaggauggcauggggagggagcuacauugcccuggacuccggucggggccgcugggauuguaucaugacaucauaccaguauuugauaauucagaacacuaccugggaggaccacugccaguucagucgaccgagccccaucggguaccucggacuguuaucucaacguacaagagauauuuauaucuccaggcggcugcucggcaccuuuacguggacucuuucagacagcgaagguaaggauacaccugggggauacugucugacccgcuggauguugaucgaggcugagcuaaaaugcuucggcaauacugccguugcgaaguguaacgaaaaacaugacgaggaauuuugcgauaugcugagacucuucgacuuuaauaagcaggcaauucagaggcugaaagccgaggcucagaugaacauacaacuuaucaauaaggccgugaacgcacugauuaaugaucaguugaucaugaagaaccaccuccgggacauaaugggcauuccauauugcaauuacaguaaauauugguaccugaaccacacaaccacggggaagaccucuuuaccccgcuguuggcuggucuccaauggaagcuaccuaaacgaaacacauuucucggacgauaucgagcagcaagcugacaauaugaucacugagaugcuccagaaagaauauauggagcgacaggguaagaccccucugggccuuguggauuuguucguguuuucuacauccuucuaccugauuucaaucuuucuccaccuggucaaaauuccaacucauagacacauaguugggaagcccugcccuaaaccacauaggcuuaaccacaugggaaucuguaguugcggcuucuauaagcagccgggugugcccguaaaguggaaacgguga

SEQ ID NO: 1540 - RNA, 1476 nt, Artificial Sequence
  derived and/or modified CDS sequence (opt3) from Lassa virus__AIT17204__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgucuucacuguauaaagggguuuacgaauugcagacccucgagcugaacauggaaacacugaauaugacuaugccucucaguuguaccaagaacagcucccaucacuauaucagggugggaaaugagacaggcuuagagcugacccuuacuaacacaucuauuaucaaucauaaauuuugcaacuugucggacgcccacaagaaaaaucuguacgaucaugcgcuaaugucaauaaucagcaccuuccaccucaguauuccaaacuuuaaucaguaugaagcuauguccugugacuucaacggugggaagaucucuguccaguacaaucugagccacuccuaugccggagaugcagccaaccauugcggcacgguggcuaauggcguacuucaaacuuuuaugcggauggcauggggagggucauacauugcccuggacaguggucacgaucgcugggacuguaucaugaccagcuaccaguauuugauaauucagaacacaacuugggaggaucauugccaguucucucgaccgucccccaucggcuaccucgggcuguuaucacaacguaccagagacauuuauaucagcaggcggcugcucggaacauuuaccuggacgcuuagugauucugaaggcaaggacacuccugguggguacugucugacacgcuggauguugaucgaggcugagcuaaaaugcuucggaaacaccgccguugcgaaguguaaugaaaaacacgaugaggaauuuugcgacaugcugagacucuucgauuuuaacaagcaggcaauucagaggcugaaagccgaggcucagauguccauacaacuuaucaauaaggccgugaacgcacugauuaaugaccaguugaucaugaagaaccaccuccgggacauaaugggcauuccauauugcaauuacagcaaauauugguaccugaaccauacuaucacaggcaagaccucguuacccaaauguuggcuggucucuaauggguccuaccuaaacaagacgcacuucucagaugacaucgaacagcaagcugauaauaugauuaccgagaugcuccagaaagaguauauggaacgccagggaaagacaccucugggucuuguggacuuguucguguuuaguacuagcuucuaccugaucuccauuuuucuccaucugauaaaaaucccaacccaccgacauauugucggcaagcccugcccuaagccacacagacuuaaccacauggggaucuguucuugcggacuguauaaacagccgggcguucccgugaaguggaaaagguga

SEQ ID NO: 1541 - RNA, 1476 nt, Artificial Sequence
  derived and/or modified CDS sequence (opt3) from Lassa virus__AIT17208__GPC
augggccagaucgugaccuucuuucaagaggucccccacguuauugaagaggugaugaacauaguacugaucgcccucagcauucuugcugugcugaagggguuguacaauuucgcaacaugcggauuaaucggucuggucacuuuucuacuccuguguggcagauccugcacgaccucucuuuauaaagggguguacgaacugcagacauuggagcucaacauggaaacucugaauaugaccaugccucugucauguacaaagaacaauagucaucacuauauuaugguuggaaacgagaccggccucgaguuaacucugacaaauaccagcaucauaaaccauaaauucugcaaucuuuccgacgcccacaagaaaaacuuguacgaucaugcgcugaugucuaucauuucgacguuucaccuaucaaucccaaauuucaaccaguaugaagcuaugagcugugacuuuaauggugggaagauuagugugcaguacaaccucucccacucuuaugccggagaugcagccaaucauugcggcacugucgcuaacggcgugcugcaaaccuucaugaggauggcauggggagggagcuacaucgcccuugacuccggucggggccagugggauuguauaaugacaucauaccaguaucugauuauccagaacacuaccugggaggaccacugccaauuuagucgcccgagccccauuggguacuugggacuccugucucagcgaacacgugauaucuauaucuccagaagguuacugggcaccuucacguggacucucucagacagcgaagguaaggauacaccugggggauacugucuuacccgguggaugcugauugaggcugaguugaaaugcuuuggcaauacugccguagcgaaguguaacgaaaaacaugacgaggaguucugcgauaugcuacgccuguuugacuucaauaagcaggcaauacagagacucaaagccgaagcucaaaugaguauccagcugauuaacaaggccguuaaugcacuuaucaacgaucagcugauaaugaagaaucacuugagggacauuaugggcaucccauauugcaacuacucuaaauauugguaccucaaucacacaaccacggggaagaccucccugcccaaauguugguuagugagcaacggaucguaccugaaugaaacacauuucucugacgauaucgagcaacaggcugacaacaugauuacugagaugcuacagaaggaauauauggagcggcaggguaaaaccccucucggccuggucgaucuuuuuguguucuccacaucauuuuacuugaucaguauuuuccugcaccucgugaagauaccaacucaucgccacaucgucgggaaaagcugccccaagccucaucgacugaaucacaugggaauuuguuccugcggccuuuauaagcaaccagguguuccggugaaauggaagagauga

SEQ ID NO: 1542 - RNA, 1476 nt, Artificial Sequence
  derived and/or modified CDS sequence (opt3) from Lassa virus__AIT17210__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucaaccauaaauuuugcaauuuguccgacgcccacaagaaaaaccuguacgaucaugcgcuaaugucuauaaucucgacguuccaccucucaauuccaaauuuuaaccaguaugaagcuaugagcugugacuucaauggugggaagaucaguguccaguacaaccugucccacucuuaugccggagaugcagccaaucauugcggcacuguggcuaacggcguacuucaaaccuuuaugaggauggcauggggagggagcuacauugcccuggacuccggucgggaucgcugggacuguaucaugacaucauaccaguauuugauaauucagaacacuaccugggaggaucacugccaguucagucgaccgagccccaucggcuaccucgggcuguuaucucaacguacaagagacauuuauaucuccaggcggcugcucggaaccuuuacguggacucuuucagauagcgaaggcaaggacacaccugguggguacugucugacccgcuggauguugaucgaggcugagcuaaaaugcuucggaaauacugccguugcgaaguguaacgaaaaacaugaugaggaauuuugcgacaugcugagacucuucgauuuuaauaagcaggcaauucagaggcugaaagccgaggcucagaugaguauacaacuuaucaacaaggccgugaaugcacugauuaacgaccaguugaucaugaagaaucaccuccgggacauaaugggcauuccauauugcaacuacucuaaauauugguaccugaaucacacaaccacgggcaagaccuccuuacccaaauguuggcuggucagcaacgggucguaccuaaaugaaacacauuucucugaugacaucgagcagcaagcugauaacaugaucacugagaugcuccagaaggaauauauggagcgccagggaaaaaccccucugggucuuguggacuuguucguguuuuccacaucauucuaccugauuaguaucuuucuccgacuggucaagauuccaacucacagacauauaguuggcaaacccugcccuaagccacacaggcuuaaucauauggggaucuguagcugcggacuguauaagcagccgggcgugcccguaaaauggaagcgguga

SEQ ID NO: 1543 - RNA, 1476 nt, Artificial Sequence
  derived and/or modified CDS sequence (opt3) from Lassa virus__AIT17212__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucaaccauaaauuuugcaauuuguccgacgcccacaggaagaaccuguacgaucaugcgcuaaugucuauaaucucgacguuccaccucucaauuccaaauuuuaaccaguaugaagcuaugagcugugacuucaauggugggaaaaucaguguccaguacaaccugucccacucuuaugccggagaugcagccaaucauugcggcacuguggcuaacggcguacuucaaaccuuuaugcggauggcauggggagggagcuacauugcccuggacuccggucgcggcaagugggauuguaucaugacaucauaccaguauuugauaauucagaacacuaccugggaggaccacugccaguucagucgaccgagccccaucggguaccucggacuguuaucucaacguacaagagauauuuauaucuccaggcggcugcucggcaccuuuacguggacucuuucagacagcgaagguaaggauacaccugggggauacugucugacccgcuggauguugaucgaggcugagcuaaaaugcuucggcaauacugccguugcgaaguguaacgaaaaacaugacgaggaauuuugcgauaugcugagacucuucgacuuuaauaagcaggcaauucagaggcugaaagccgaggcucagaugaguauacaacuuaucaacaaggccgugaaugcacugauuaacgaucaguugaucaugaagaaucaccuccgggacauaaugggcauuccauauugcaacuacucuaaauauugguaccugaaucacacaaccacggggaagaccuccuuaccccgcuguuggcuggucagcaacggaucguaccuaaaugaaacacauuucucugacgauaucgagcagcaagcugacaacaugaucacugagaugcuccagaaagaauauauggagcgacaggguaagaccccucugggccuuguggauuuguucguguuuuccacaucauucuaccugauuaguaucuuucuccaccuggucaaaauuccaacucauagacacauaguugggaagcccugcccuaaaccacauaggcuuaaucacaugggaaucuguagcugcggccuguauaagcagccgggugugcccguaaaguggaaacgguga

SEQ ID NO: 1544 - RNA, 1476 nt, Artificial Sequence
  derived and/or modified CDS sequence (opt3) from Lassa virus__AIT17216__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccggagaugcagccaaucauugcggcacuguggcuaacggcguacugcaaaccuucaugaggauggcauggggagggagcuacauugcccuugacuccggucacggccggugggauuguaucaugacaucauaccaguaucugauaauucagaacacuaccugggaggaccauugccaguuuagucgcccgagccccaucggguacuugggacuccugucucaacgaacacgugauauuuauaucuccagaagguuacugggcaccuucacguggacucucucagacagcgaagguaaggauacaccugggggauacugucuuacccgguggaugcugaucgaggcugaguugaaaugcuuuggcaauacugccguugcgaaguguaacgaaaaacacgacgaggaguucugcgauaugcuacgccuguuugacuucaauaagcaggcaauucagagacucaaagccgaagcucagaugaguauacaacugaucaacaaggccgugaaugcacuuauuaacgaucagcugaucaugaagaaucacuugagggacauaaugggcauuccauauugcaacuacucuaaauauugguaccucaaucauacaaccacggggaagaccucccugcccaaauguugguuagucagcaacggaucguaccugaaugaaacacacuucucugacgauaucgagcagcaagcugacaacaugaucacugagaugcuacagaaggaauauauggagcggcaggguaaaaccccucucggccugguggaucuuuuuguguucuccacaucauuuuacuugauuaguaucuuccugcaucucgucaagauuccaacucaccgccauauaguugggaaacccugcccuaagccacaccgacugaauuauaugggaaucuguagcugcggccuuuacaagcagccgggugugcccguaagauggaaaagguga

SEQ ID NO: 1545 - RNA, 1476 nt, Artificial Sequence
  derived and/or modified CDS sequence (opt3) from Lassa virus__AIT17224__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuacuccuguguggcagauccugcacgaccacacuuuauaaagggguuuacgaacugcaggccuuggagcucaacauggaaacucugaauaugaccaugccucugucuuguacaaagaacaauucacaucacuauauuagggugggaaacgacaccggccucgaguuaacucugacaaauaccaguaucauacagcauaaauuuugcaaccuuagcgaugcgcacaagaaaaauuuguacgaccauacgcugauguccaucauuucuacuuuccaccuaucgaucccaaacuuuaaucaguaugaggcuaugucaugugauuucaacggugggaagauuagcguccaauacaaucucagucacuccuaugccggagacgcagccucucauugcggcaccguggcuaacggcguacugcagacauuuaugcggauggcauggggagggagcuacaucgcccuugauuccggucgcggcaauugggacuguauaaugacuucauaccaguaucugauuauccagaacaccacaugggaagaucacugccaauucagucgaccgagccccauuggguacuugggacuccugucucagcguaccagagacaucuauaucuccaggcgguuacugggcacguuuacuuggacacucucagauagcgagggucgcgacaccccugggggauacugucuuacuagauggaugcugauugaagcugaguugaagugcuucggcaacacagccguugcgaaauguaaugagaagcaugaugaagaguuuugcgacaugcuaaggcuguucgauuuuaacaaacaggcaauacagcggcucaagaccgaagcccaaaugaguauccagcugauuaauaaagcugugaacgcccuuaucaaugaccagcugauaaugaagaaccacuugcgcgacauuaugggcaucccauauugcaauuacucuaaguauugguaccucaacaauacgaucaccgggaaauccagccugcccaaguguugguuagucucgaacggaucuuaccugaaugagacacacuucuccgaugacauugaacaagaggcagauaacaugaucacugagaugcuacagaaagaauauauggagcgacaggguaagaccccucucggccugguggaccuuuucguguuuucaacaaguuucuacuugauuagcauauuucugcaucucgucaaaaucccaacucacagacauauuguugggaagcccugcccuaaaccacacaggcugaaucauaugggaguguguuccugcggccuuuauaagcagccggguguacccgugcgguggaagcguuga

SEQ ID NO: 1546 - RNA, 1476 nt, Artificial Sequence
  derived and/or modified CDS sequence (opt3) from Lassa virus__AIT17228__GPC
augggccagaucgugaccuucuuucaagaggucccccacguuauugaagaggugaugaacauaguacugaucgcccucagcauucuugcugugcugaagggguuguacaauuucgcaacaugcggauuagucggucugcuaacuuuucuccugcuuuguggcagauccugcacgaccucucuguauaaagggguguacgaauugcagacacucgagcugaacauggaaacucugaauaugaccaugccucucucauguacaaagaacaauagucaucacuauaucaugguuggaaacgagaccggcuuagagcugacucuuacaaauaccagcauuaucgaccauaaauucugcaacuuguccgaugcccacaagaaaaaucuguacgaccaugcgcuaaugucuauaaucucgacguuucaccucucaauuccaaacuucaaucaguaugaagcuaugagcugugauuuuaacggugggaagaucagugugcaguacaaucugucccacucuuaugccggagacgcagccaaccauugcggcacugucgcuaauggcgugcuucaaaccuucaugaggauggcauggggagggagcuacauugcccuggauuccggucggggcgggugggacuguaucaugacaucauaccaguauuugauaauucagaacacuaccugggaggaucacugccaguuuagucgcccgagccccaucggauaccucggccuguuaucucaacgaacacgugacauuuauaucuccagaaggcugcucgguaccuucacguggacucuuucagauagcgaagggaaggacacaccuggaggcuacugucugacccgguggauguugaucgaggcugagcuaaaaugcuuuggcaacacugccguagcgaaguguaaugaaaaacaugaugaggaguucugcgacaugcugcgccucuuugauuucaacaagcaggcaauucagagacugaaagccgaagcucagaugaguauacaacuuaucaauaaggccguuaacgcacugauuaaugaccaguugaucaugaagaaccaccucagggacauaauggggauuccauauugcaauuacucuaaauauugguaccugaaccacacaaccacgggaaagaccuccuuacccaaauguuggcuggugagcaaugguucguaccuaaacgaaacacauuucucugaugacaucgagcagcaagcugauaauaugaucacugagaugcuccagaaggaauauauggagcggcagggcaaaaccccucuggggcuugucgacuuguuuguguucuccacaucauuuuaccugauuaguaucuuccuccaccuggugaagauuccaacucaucgccacauagucggaaaaagcugccccaagccucaucgacuuaaccacaugggcaucuguuccugcggucuguauaagcagccagggguuccggugaaauggaagagauga

SEQ ID NO: 1547 - RNA, 1476 nt, Artificial Sequence
  derived and/or modified CDS sequence (opt3) from Lassa virus__AIT17232__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucagggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaaugaggguaagaucaguguccaguacaaccucucccacucuuaugccggggaugcagccaaucauugcggaacuguggcuaacggcguacugcaaaccuucaugcggauggcauggggcgggagcuacauugcccuugacuccggacgcgguaagugggauuguaucaugacaucauaccaguaucugauaauucagaacacuaccugggaagaccacugccaguuuagucgaccgagccccaucggcuacuuggggcuccugucucaacguacaagagauauuuauaucuccaggcgguuacugggaaccuucacguggacucucucagacagcgagggcaaagauacaccugguggguacugucuuacccgcuggaugcugaucgaggcugaauugaagugcuuuggaaauacugccguugcgaaauguaacgagaagcaugacgaagaguucugcgauaugcuaagacuguuugacuucaauaaacaggcaauugaaaggcucaaggccgaggcucagaugaguauacagcugaucaacaaggccgugaaugcacuuauuaacgaucaacugaucaugaaaaaucacuugcgggacauaaugggcauuccauauugcaacuacucuaaguauugguaccucaaucacacaaccacgggcaaaaccucccugcccaaguguugguuagucagcaacgggucguaccugaaugagacacauuucucugacgauaucgaacagcaggcugacaacaugaucacugagaugcuacaaaaagaauauauggagcgccagggaaagaccccucucggucugguggaucuuuuuguguucuccacaucauuuuacuugauuaguaucuuccugcaccucgucaaaauuccaacucaucgacacauaguuggcaagagcugccccaagccucauagacugaaucacauggggaucuguuccugcggacuuuauaaacagccaggcgugccgguaaaguggaaaagguga

SEQ ID NO: 1548 - RNA, 1476 nt, Artificial Sequence
  derived and/or modified CDS sequence (opt3) from Lassa virus__AIT17236__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaggaucaguguccaguacaaccucucccacucuuaugccggagaggcagccaaucauugcggcacuguggcuaacggcguacugcaaaccuucaugcggauggcauggggagggagcuacauugcccuugauuccggucgcggcaagugggacuguaucaugacaucauaccaguaucugauaauucagaacacuaccugggaagaucacugccaguuuagucgaccgagccccaucggguacuugggacuccugucucaacguacaagagacauuuauaucuccaggcgguuacugggcaccuucacguggacucucucagauagcgaggguaaggacacaccugggggauacugucuuacccgcuggaugcugaucgaggcugaauugaaaugcuuuggcaauacugccguugcgaaguguaacgagaaacaugaugaagaguucugcgacaugcuaagacuguuugauuucaauaagcaggcaauucagaggcucaaagccgaagcucagaugaguauacaacugaucaacaaggccgugaaugcacuuauuaacgaccagcugaucaugaagaaucacuugcgggauauaaugggcauuccauauugcaacuacucucgcuauugguaccucaaucacacaaccacggggaaaaccucccugcccaaguguugguuagucagcaacggaucguaccugaaugagacacauuucucugacgacaucgagcagcaagcugauaacaugaucacugaaaugcuacagaaagaguauauggaacgacaggguaagaccccucucggccugguggaccuuuuuguguucuccacaucauuuuacuugauuaguaucuuccugcaccucgucaaaauuccaacucauagacacauaguuggaaagagcugccccaaaccucauaggcugaaucacauggggaucuguuccugcggccuuuauaagcagccaggugugccgguaaaguggaaacgguga

SEQ ID NO: 1549 - RNA, 1476 nt, Artificial Sequence
  derived and/or modified CDS sequence (opt3) from Lassa virus__AIT17240__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaaggguuuuacgaauugcagacacucgagcugaacauggaaacucugaauaugaccaugccucucucauguacaaagaacaauagucaucacuauaucaggguuggaaacgagaccggcuuagagcugacucuuacaaauaccagcauuaucgaccauaaauucugcaacuuguccgaugcccacaagaaaaaucuguacgaccaugcgcuaaugucuauaaucucgacguuucaccucucaauuccaaacuucaaucaguaugaagcuaugagcugugauuuuaacggugggaagaucagugugcaguacaaucugucccacucuuaugccggagacgcagccaaccauugcggcacugucgcuaauggcgugcuucaaaccuucaugcggauggcauggggagggagcuacauugcccuggauuccggucgcggccgaugggacuguaucaugacaucauaccaguauuugauaauucagaacacuaccugggaggaucacugccaguuuagucguccgagccccaucggguaccucggacuguuaucucaaaagacaagagacauuuauaucuccaggcggcugcucggcaccuucacguggacucuuucagauagcgaagguaaagacacaccugggggauacugucugacccgcuggauguugaucgaggcugagcuaaagugcuuuggcaacacugccguagcgaaauguaaugaaaagcaugaugaggaguucugcgacaugcugagacucuuugauuucaacaaacaggcaauucagaggcugaaggccgaagcucagaugaguauacaacuuaucaauaaggccguuaacgcacugauuaaugaccaguugaucaugaaaaaccaccuccgggacauaaugggcauuccauauugcaauuacucuaaguauugguaccugaaccacacaaccacggggaaaaccuccuuacccaaguguuggcuggugagcaauggaucguaccuaaacgaaacacauuucucugaugacaucgagcagcaagcugauaauaugaucacugagaugcuccagaaagaauauauggagcgccaggguaagaccccucugggccuugucgacuuguuuguguucuccacaucauuuuaccugauuaguaucuuccuccaccuggugaaaauuccaacucaucgacacauagucggaaagagcugccccaagccucauagacuuaaccacauggggaucuguuccugcggccuguauaaacagccagguguuccggugaaguggaaaagguga

SEQ ID NO: 1550 - RNA, 1476 nt, Artificial Sequence
  derived and/or modified CDS sequence (opt3) from Lassa virus__AIT17244__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccaaccuguauaaagggguuuacgaauugcagacacucgagcugaauauggaaacucugaacaugaccaugccucucucuuguacaaagaacucaagucaucacuauaucagggugggaaaugagaccggcuuagagcugacucuuacaaauaccagcauuaucgaccauaaauuuugcaacuuguccgaugcccacaagaaaaaucuguacgaccaugcgcuaaugucuauaaucucgacguuccaccucucaauuccaaacuuuaaucaguaugaagcuaugagcugugauuucaacggugggaagaucaguguccaguacaaucugucccacucuuaugugggagacgccgcagaucauugcggcacuguagccaacggcguucuucaaaccuuuaugcggauggcuuggggagggagcuacauugcacuggacuccggucgcggcaagugggauuguaucauaacaucauaccaguauuugauuauccagaauacuaccugggaggaccacugccaguucagucgaccgagccccauuggguaccucggacuguuaucucaacguacaagagauaucuauaucuccaggcggcugcucggcaccuuuacguggacucuuucagacagcgaagguaaagauacaccugggggauacugucugacccgcuggauguugauugaggccgagcuaaagugcuucggcaacacugcuguggccaaauguaacgaaaagcaugacgaggaauuuugcgauaugcugagacucuucgacuuuaauaaacaggcgauacagaggcugaaggcagaggcccagaugaguauccaacuuauuaacaaggcugucaaugcccugaucaacgaccaguugauaaugaaaaaucaccuccgggauauuaugggcaucccauauugcaacuacucuaaguauugguaccugaaucacacaaucaccgggaaaacguccuuaccccgcuguuggcuggugagcaacggaucguaccuaaaugaaacccgauucucugacgauauugagcagcaagcagacaacaugaucacagagaugcuccagaaggaauauauggagagacaggguaaaacuccucugggccuuguggauuuguucgucuuuuccaccucauucuaccugauuaguauauuucuccaucugguuaagaucccaacacacaggcauauuguggggaaacccugcccuaagccacaccggcuuaaucauaugggaaucuguagcugcggccuguauaagcagccggguguacccgugaaauggaagcguuga

SEQ ID NO: 1551 - RNA, 1476 nt, Artificial Sequence
  derived and/or modified CDS sequence (opt3) from Lassa virus__AIT17246__GPC
augggccagaucgugaccuucuuucaagaggucccccacguuauugaagaggugaugaacauaguacugaucgcccucagccuucuggcuguguugaagggguuauacaaugucgcaacaugcggacugauuggucuaaucacuuuccuccugcuuuguggcagauccugcacgaccaaccuguauaaagggguguacgaauugcagacacucgagcugaauauggaaacucugaacaugaccaugccucucucuuguacaaagaacucaagucaucacuauauuaugguuggaaaugagaccggcuuagagcugacucuuacaaauaccagcaucauaaaccauaaauuuugcaauuuguccgacgcccacaagaaaaaccuguacgaucauacgcuaaugucuaucauuucgacuuuccaccucucaaucccaaauuuuaaccaguaugaagcgaugagcugugacuucaauggugggaagauuagugugcaguacaaccugucccacucuuaugcugucgaugccgcaaaucauugcggaaccguggccaacggcauccuucaaacauuuaugaggauggcuuggggcgggagcuacauagcacuggacuccggacgggguaacugggauuguauuaugacuucauaccaguauuugaucauucagaauaccacaugggaggaccacugccaguucagucgcccgagccccaucggcuaccucgggcuguuaucucaacgaacccgugauaucuauauuuccagaaggcugcucggaacguuuacuuggacacuuucagacagcgaaggcaacgauaccccugguggguacugucugacucgguggauguugauagaggccgagcuaaagugcuucggaaauacagcuguagccaaauguaacgaaaagcaugacgaggaauuuugcgauaugcugcgccucuucgacuuuaauaaacaggcgauccagagacugaaggcagaggcccagaugaguauucaacuuaucaacaaagcuguuaaugcccugauaaacgaucaguugauuaugaagaaucaccucagggacaucaugggcaucccauauugcaacuacucuaaguauugguaccugaaucacaccacgaccggcaaaacauccuuacccaaguguuggcuggugagcaacgggucguaccuaaaugaaacucauuucucugacgauauugagcagcaagcagacaacaugaucaccgagaugcuccagaaagaauauauggagcggcagggaaagacaccucugggucuugucgauuuguucguguuuuccacuucauucuaccugauuaguauauuucuccaccuggugaaaaucccaacccaucgccacauugucggcaagcccugcccuaaaccacaucgacuuaaucacauggggaucuguagcugcggacuguauaagcagccgggcguucccgugagauggaagagguga

SEQ ID NO: 1552 - RNA, 1476 nt, Artificial Sequence
  derived and/or modified CDS sequence (opt3) from Lassa virus__AIT17250__GPC
augggccagaucgugaccuucuuucaagaggucccccacguuauugaagaggugaugaacauaguacugaucgcccucagccuucuggcuguguugaagggguuauacaaugucgcaacaugcggacugauuggucuagugacuuuccuccugcuuuguggcagauccugcacgaccaaccuguauaaagggguuuacgaauugcagacacucgagcugaauauggaaacucugaacaugaccaugccucucucuuguacaaagaauaacucacaucacuauaucauggugggaaaugagaccggcuuagagcugacucuuacaaacaccaguauuaucaaucauaaauuuugcaacuugagcgacgcccacaagaaaaaucuguacgaucauacgcuaauguccauaaucucuacuuuccaccucucgauuccaaacuuuaaucaguaugaagcgaugucaugugacuucaacggugggaagaucagcguccaguacaaucugagucacuccuaugcuguggaugccgcaaaccauugcggaaccguagccaacggcguucuucaaacauuuaugaggauggcuuggggcgggucuuacauugcacuggacagcggacgggguaauugggauuguaucaugacuuccuaccaguauuugauaauucagaacaccacaugggaggaccacugccaguucucacgcccgagucccaucggcuaccucgggcuguuaagccaacgaacccgugauauuuauaucucuagaaggcugcucggaacguuuacuuggacacuuuccgacucagaaggcaaugauaccccugguggguacugucugacucgguggauguugaucgaggccgagcuaaagugcuucggaaacacagcuguggccaaauguaaugaaaagcaugacgaggaauuuugcgauaugcugcgccucuucgacuuuaacaaacaggcgauucagagacugaaggcagaggcccagaugagcauacaacuuaucaauaaagcugucaacgcccugauuaaugaucaguugaucaugaagaaccaccucagggacauaaugggcauuccauauugcaauuacaguaaguauugguaccugaaccacaccacgaccggcaaaacaucuuuacccaaguguuggcugguguccaaugggagcuaccuaaacgaaacucauuucucggacgauaucgagcagcaagcagacaauaugaucaccgagaugcuccagaaagaauauauggagcggcagggaaagacaccucugggucuuguggauuuguucgucuuuucuacuuccuucuaccugauuucaaucuuucuccaccugguuaaaauuccaacccaucgccacauagugggcaagcccugcccuaaaccacaucgacuuaaccacauggggaucuguaguugcggacuguauaagcagccgggcguacccgugagauggaagagguga

SEQ ID NO: 1553 - RNA, 1476 nt, Artificial Sequence
  derived and/or modified CDS sequence (opt3) from Lassa virus__AIT17254__GPC
augggccagaucgugaccuucuuucaagaggucccccacguuauugaagaggugaugaacauaguacugaucgcccucagcauucuugcugugcugaagggguuguacaauuucgcaacaugcggaaucgucgguuuagugacuuuucugcuacucuguggcagauccugcacgaccucucuguauaaagggguuuacgaacuucagacacuggaguugaacauggaaacucucaauaugaccaugccucugucauguacaaagaacaauagucaucacuauauuauggugggaaacgagaccggccuggagcucacuuuaacaaauaccagcaucauaaaccauaaauucugcaaucuguccgacgcccacaagaaaaaccuuuacgaucaugcguugaugucuaucauuucgacguuucaccugucaaucccaaauuucaaccaguaugaagcuaugagcugugacuuuaauggugggaagauuaguguccaguacaaccuaucccacucuuaugccggagaugcagccaaucauugcggcacuguggcuaacggcguacuccaaaccuucaugaggauggcauggggagggagcuacaucgcccuggacuccggucgggaucgcugggacuguauaaugacaucauaccaguaucuuauuauccagaacacuaccugggaggaucacugccaguuuagucgaccgagccccauuggcuaccugggguugcucucucaacguacaagagacaucuauaucuccaggcggcuguuaggaaccuucacguggacucugucagauagcgaaggcaagaauacaccugguggguacugucucacccgcuggaugcuuauugaggcugagcugaaaugcuuuggaaacacugccguugcgaaguguaaugaaaaacaugacgaggaguucugcgauauguugagacuauuugacuucaacaagcaggcaauacagaggcugaaagccgaagcucagaugaguaucucucucauuaauaaggccgugaacgcacugaucaaugaucaacuuauaaugaagaaccaucugcgggacauuaugggcaucccauauugcaauuacuccaaauauugguacuugaaccacacaaccacgggcaagaccagccucccccgcuguuggcuggucucgaaugggucuuacuuaaacgaaacacacuucuccgacgauaucgagcagcaggcugacaauaugauuacugagaugcugcaaaaagaauauauggaucgacagggaaagaccccucuaggucucguggaccuguuuguguucucaacaaguuuuuaccuuaucagcauuuucuugcaccuggucaaaauaccaacucauagacacaucguuggcaagaccugccccaaaccucauaggcucaaccacauggggauuuguuccugcggacuguauaagcagccaggcgugccgguaaaguggaaacgguga

SEQ ID NO: 1554 - RNA, 1476 nt, Artificial Sequence
  derived and/or modified CDS sequence (opt3) from Lassa virus__AIT17258__GPC
augggccagaucgugaccuucuuucaagaggucccccacguuauugaagaggugaugaacauaguacugaucgcccucagcauucuugcugugcugaagggguuguacaauaucgcaacaugcggauuagucggucuggugacuuuccuacuccuguguggcagauccugcacgaccucucuuuauaaagggguuuacgaacugcagacauuggagcucaacauggaaacucugaauaugaccaugccucugucauguacaaagaacaauagucaucacuauauuauggugggaaacgagaccggccucgaguuaacucugacaaauaccagcaucauaaaccauaaauuuugcaaucuuuccgacgcccacaagaaaaacuuguacgaucaugcgcugaugucuaucgucucgacguuccaccuaucaauuccaaauuuuaaccaguaugaagcuaugagcugugacuucaauggugggaagaucagugugcaguacaaccucucccacucuuaugccguagaugcagccaaucauugcggaacuguugcuaacggcgugcugcaaaccuuuaugaggauggcauggggcgggagcuacauugcccuugacuccggacgggguggcugggauuguaucaugacaucauaccaguaucugauaauucagaacgucacuugggaggaccacugccaguucagucgcccgagccccaucggguacuugggacuccugucucaacgaacccgugauguguauauuuccagaagguuacugggcacauuuaccuggacgcucucagacagcgaagguaaugauacuccugggggauacugucuuacacgguggaugcugaucgaggcugaguugaagugcuucggcaacaccgccguggcgaaauguaaugaaaagcaugacgaggaauuuugcgauaugcuacgccuguucgacuuuaacaaacaggcaauccagagacucaaggccgaggcucagaugaguauucaacugauaaauaaagccgucaacgcacuuaucaaugaucagcugauuaugaagaaccacuugagggacaucaugggcauaccauauugcaauuacucuaaguauugguaccucaaccacacuacaaccgggaaaacgucccugcccaaguguugguuaguuagcaauggaucguaccugaacgaaacccauuucucugacgauauugagcagcaagcugacaauaugaucacagagaugcuacagaaagaauauauggagcggcaggguaagacuccucucggccugguggaucuuuucguauuuuccaccucauucuacuugaucaguauuuuucugcaccucgugaaaaucccaacacaucgccacauugucgggaagcccugcccuaaaccacaucgacugaaccacaugggaauauguagcugcggccuuuauaagcagccgggugugcccguuaaguggaaaagauga

SEQ ID NO: 1555 - RNA, 1476 nt, Artificial Sequence
  derived and/or modified CDS sequence (opt3) from Lassa virus__AIT17262__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucaaccauaaauuuugcaauuuguccgacgcccacaagaaaaaccuguacgaucaugcgcuaaugucuauaaucucgacguuccaccucucaauuccaaauuuuaaccaguaugaagcuaugagcugugacuucaauggugggaagaucaguguccaguacaaccugucccacucuuaugccggagaugcagccacucauugcggcaccguggcuaauggcguacuucaaacauuuaugaggauggcauggggagggagcuacauugcccuggacuccggucggggcaagugggauuguaucaugacuucauaccaguauuugauaauucagaacaccacaugggaggaccacugccaguucagucgcccgagccccaucggguaccucggacuguuaucucaacgaacccgugauauuuauaucuccagaaggcugcucggcacguuuacuuggacacuuucagacagcgaagguaaagauaccccugggggauacugucugacucgguggauguugaucgaggcugagcuaaagugcuucggcaacacagccguugcgaaauguaaugaaaagcaugacgaggaauuuugcgauaugcugcgccucuucgacuuuaacaaacaggcaauucagagacugaagaccgaggcccagaugaguauacaacuuaucaauaaggcugugaacgcccugauuaaugaucaguugaucaugaaaaaccaccucagggacauaaugggcauuccauauugcaauuacucuaaguauugguaccugaaccacacgaccacagggaaaacuuccuuaccccgguguuggcuggucagcaauggaucguaccuaaacgaaacccauuucucugacgauaucgagcagcaagcagacaauaugaucacagagaugcuccagaaggaauauauggagcgccaggguaaaacuccucugggccuuguggauuuguucguguuuuccaccucauucuaccugauuaguaucuuucuccaccuggucaagauuccaacacaucgacacauaguugggaaacccugcccuaagccacauagacuuaaccacaugggaaucuguagcugcggccuguauaagcagccgggugugcccguaaaauggaagagguga

SEQ ID NO: 1556 - RNA, 1476 nt, Artificial Sequence
  derived and/or modified CDS sequence (opt3) from Lassa virus__AIT17266__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcuugauuaaccauaaauuuugcaaucuguccgacgcccacaagaaaaaccuauacgaucaugcgcucaugucuaucauaucgacguuccaccugucaaucccaaauuuuaaccaguaugaagcuaugagcugugacuucaauggugggaagauuaguguccaguacaaccuuucccacucuuaugccguggaugcagccaaucauugcggaacuguagcuaacggcguucugcaaaccuuuaugaggauggcauggggcgggagcuacaucgccuuggacuccggacgggguggcugggauuguauuaugacaucauaccaguaucucaucauacagaacacuaccugggaggaccacugccaguucagucgcccgagccccauuggguaccugggauuacugucucaacgaacacgugauaucuauauuuccagaaggcuccuuggcaccuuuacguggacucugucagacagcgaagguaaggauacaccugggggauacuguuugacccgguggaugcuaaucgaggcugagcugaaaugcuucggcaauacugccguggcgaaguguaacgaaaaacaugacgaggaauuuugcgauaugcuccgccuguucgacuuuaauaagcaggcaauccagagacuuaaagccgaggcucagaugaguauucaacugauaaacaaggccgucaaugcauugaucaacgaucagcucauuaugaagaaucaccugagggacaucaugggcauaccauauugcaacuacucuaaauauugguacuuaaaucacacaaccacggggcggaccucccugccccgcuguuggcuagugagcaacggaucguaccucaaugaaacacauuucucugacgauauugagcagcaagcugacaacaugaucacugagaugcugcagaaggaauauauggagcgacaggguaaaaccccucuuggcuugguggaucuguucgucuuuuccacaucauucuaccucaucaguauuuuucugcaccuuguuaagaucccaacucauagacacauuguggggaaaagcugccccaagccucauaggcugaaucacaugggaauauguuccugcggcuuguauaaacagccagguguaccggugaaguggaagcgguga

SEQ ID NO: 1557 - RNA, 1476 nt, Artificial Sequence
  derived and/or modified CDS sequence (opt3) from Lassa virus__AIT17270__GPC
augggccagaucgugaccuucuuucaagaggucccccacguuauugaagaggugaugaacauaguacugaucgcccucagcgugcuugcuguccugaagggguuguacaauuucgcaacaugcggauuagugggucugguuacuuuucuacuccuguguggcagauccugcucuacgucaguguauaaaggggucuacgaacuucagacccuggaguugaacauggaaacacucaauaugacuaugccucugaguuguaccaagaacaauagccaucacuauauuauggugggaaacgagacaggccuggagcucaccuuaacuaauacauccaucauuaaccauaaauucugcaaucugucugacgcccacaagaaaaaccuuuacgaucaugcguugaugucgaucauaucaaccuuucaccugagcaucccaaauuucaaccaguaugaagcuaugaguugugacuuuaauggugggaagauuuccguacaguacaaccuaucucacagcuaugccguugaugcagccaaucauugcggaacgguggcuaacggcguccuccaaacuuucaugaggauggcauggggcggguccuacaucgcccuggacucaggacacgguggcugggauuguauuaugaccaacuaccaguaucuuaucauacagaauacaacuugggaggaccauugccaguuuagucggccgagccccauuggguaccugggauugcucucucaacgcacccgagauaucuauauuucccguagacuguuaggcacauucaccuggacgcugucagacagcgaagguaaggauacuccugggggauacugucucacaagguggaugcuuaucgaggcugagcugaaaugcuuuggcaacaccgccguggcgaaguguaaugaaaaacacgacgaggaguucugcgauauguugcggcuauuugacuucaacaagcaggcaauccagcgccugaaagccgaagcucagaugaguauucaacucauaaauaaggccgugaacgcacugaucaaugaucagcuuauuaugaagaaccaccugagagacaucaugggcauaccauauugcaauuacucuaaauauugguacuugaaccauacuacaaccgggaggacgucccuccccaaguguuggcuggucagcaauggaucguacuuaaacgaaacccacuucucugacgauauugagcagcaagcugacaauaugaucacagagaugcugcagcgggaauauauggagcgccaggguaaaacuccucuaggccucguugaucuguuuguguucuccaccucauuuuaccuuaucaguauuuucuugcaucugguaaagaucccaacacaccgacauauuguggggaaaagcugccccaagccucacagacucaaccacaugggaauauguuccugcggccuguauaaacagccaggugucccggugaaguggaagagguga

SEQ ID NO: 1558 - RNA, 1476 nt, Artificial Sequence
  derived and/or modified CDS sequence (opt3) from Lassa virus__AIT17274__GPC
augggccagaucgugaccuucuuucaagaggucccccacguuauugaagaggugaugaacauaguacugaucgcccucagcauucuugcugugcugaagggguuguacaaugucgcaacaugcggauuaacuggucugguggccuuccuacuccuguguggcagauccugcacgaccacacuuuauaaagggguuuacgaacugcaggcguuggagcucaacauggaaacucugaauaugaccaugccucugucuuguacaaagaacaauucacaucacuauaucagggugggaaacgagaccggccucgaguuaacucugacaaauaccaguauuaucgaacaucgguuuugcaaccuuagcgacgcucacaaaaagaauuuguacgaucaugcccugauguccauaaucucuacguuccaccuaucgauuccaaacuuuaaucaguaugaggcaaugucaugugacuucaacggugggaaaaucagcguccaguacaaucucagucacuccuaugccguggaugcugcaaaccauugcggaacuguagccaauggcguucugcaaaccuuuaugcgcauggcuuggggcgggucuuacauugcccuugacagcggacgaaacgguugggauuguaucaugacauccuaccaguaucugauaauucagaacacuaccugggaagaccacugccaguucucacguccgagucccaucggcuacuuggggcuccugagccaaagaacaagggauauuuauaucucucggcgcuuacugggaaccuuuacguggacucucuccgacucagagggcaaggauacaccugguggguacugucuuaccagauggaugcugaucgaggcggaauugaagugcuucggaaauacugcaguggccaaauguaacgagaagcaugacgaagaguuuugcgauaugcuaaggcuguucgacuuuaauaaacaggcuauucagcggcucaaggccgaagcacagaugagcauacaacugaucaacaaagcugucaaugcccuuauuaacgaucagcugaucaugaagaaucacuugcgcgacauaaugggcauuccauauugcaacuacaguaaguauugguaccucaauaacacagcgaccggcaaaacgucucugccccgauguugguuaguguccaaugggagcuaccugaacgagacccacuucucggacgauaucgagcagcaagccgacaauaugaucacagaaaugcuacagaaggaguauauggaaagacagggaaaaacuccucucggucugguggaucuuuucgucuuuucuaccuccuucuacuugauuucaaucuuucugcaucucguuaagauuccaacacacaggcauauagugggcaaacccugcccuaagccacaccggcugaaccauauggggaucuguaguugcggacuuuauaaacagccgggcgcacccguacguuggaagcgcuga

SEQ ID NO: 1559 - RNA, 1476 nt, Artificial Sequence
  derived and/or modified CDS sequence (opt3) from Lassa virus__AIT17276__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccggagaugcagccaaucauugcggcacuguggcuaacggcguacugcaaaccuucaugaggauggcauggggagggagcuacauugcccuugacuccggucacggcaagugggauuguaucaugacaucauaccaguaucugauaauucagaacacuaccugggaggaccauugccaguuuagucggccgagccccaucggguacuugggacuccugucucaacgcacacgagauauuuauaucucccguagauuacugggcaccuucacguggacucucucagacagcgaagguaaagauacaccugggggauacugucuuaccagguggaugcugaucgaggcugaguugaagugcuuuggcaauacugccguugcgaaauguaacgaaaagcacgacgaggaguucugcgauaugcuacggcuguuugacuucaauaaacaggcaauucagcgccucaaggccgaagcucagaugaguauacaacugaucaacaaggccgugaaugcacuuauuaacgaucagcugaucaugaaaaaucacuugagagacauaaugggcauuccauauugcaacuacucuaaguauugguaccucaaucauacaaccacggggaaaaccucccugcccaaguguugguuagucagcaacggaucguaccugaaugaaacacacuucucugacgauaucgagcagcaagcugacaacaugaucacugagaugcuacagaaagaauauauggagaggcaggguaagaccccucucggccugguggaucuuuuuguguucuccacaucauuuuacuugauuaguaucuuccugcaucucgucaaaauuccaacucaccggcauauaguuggaaagagcugccccaagccucaccgccugaaucacauggggaucuguuccugcggccuuuauaaacagccaggugugccgguacgauggaagagauga

SEQ ID NO: 1560 - RNA, 1473 nt, Artificial Sequence
  derived and/or modified CDS sequence (opt3) from Lassa virus__AIT17280__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucagggugggaaacgagaccggccucgaguuaacucugacaaauaccagcauuaucgaccauaaauucugcaaccuuuccgaugcccacaagaaaaauuuguacgaccaugcgcugaugucuauaaucucgacguuucaccuaucaauuccaaacuucaaucaguaugaagcuaugagcugugauuuuaacggugggaagaucaguguccaguacaaucucucccacucuuaugccggagacgcagccaaccauugcggcacuguggcuaauggcguacugcaaaccuucaugcggauggcauggggagggagcuacauugcccuugauuccggucacgagugggacuguaucaugacaucauaccaguaucugauaauucagaacacuaccugggauaaccauugccaguuuagucgcccgagccccaucggcuacuuggggcuccugucucaacgaacacgugacauuuauaucuccagaagguuacugggaaccuucacguggacucucucagauagcgaaggcaaggacacaccugguggguacugucuuacccgguggaugcugaucgaggcugaguugaaaugcuuuggaaauacugccguugcgaaguguaacgaaaaacacgaugaggaguucugcgacaugcuacgccuguuugauuucaauaagcaggcaauucagagacucaaaguggaagcccagaugaguauacaacugaucaacaaggcugucaaugcccuuauuaacgaccagcugaucaugaagaaucacuugagggacauaaugggcauuccauauugcaacuacucuaaauauugguaccucaaucauacaaccacgggcaagaccucccugcccaaauguugguuagugagcaacgggucguaccugaaugaaacacacuucucugaugacaucgagcagcaagcagauaacaugaucacugagaugcuacagaaggaauauauggagcggcagggaaaaaccccucucggucugguggaccuuuuugucuucuccacaucauuuuacuugauuaguaucuuccugcaucucguuaagauuccaacucaccgccauauagugggcaaaagcugccccaagccucaccgacugaaucacauggggaucuguuccugcggauuuuauaagcagccaggcguaccggugaaauggaagagauga

SEQ ID NO: 1561 - RNA, 1476 nt, Artificial Sequence
  derived and/or modified CDS sequence (opt3) from Lassa virus__AIT17288__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccguggaugcagccaaucauugcggaacuguagcuaacggcguucugcaaaccuucaugaggauggcauggggcgggggauacauugcccuugacagcggucggggcaacugggauuguaucaugacauccuaccaguaucugauaauucagaauacuaccugggaggaccacugccaguuuucacgcccgagucccaucggguacuugggacuccugagccaacgaacacgugauauuuauaucucuagaagguuacugggcaccuucacguggacucucuccgacucagaagguaaggauacaccugggggauacugucuuacccgguggaugcugaucgaggcugaguugaaaugcuuuggcaacacugccguggcgaaguguaaugaaaaacaugacgaggaguucugcgauaugcuacgccuguuugacuucaacaagcaggcaauucagagacucaaagccgaagcucagaugagcauacaacugaucaauaaggccgucaacgcacuuauuaaugaucagcugaucaugaagaaccacuugagggacauaaugggcauuccauauugcaauuacaguaaauauugguaccucaaccacacagugaccgggaagacgucucugcccaaauguugguuaguguccaauggaagcuaccugaacgaaacccauuucucggacgauaucgagcagcaagcugacaauaugaucacagagaugcuacagaaggaauauauggagcggcaggguaaaacuccucucggccuggucgaucuuuuuguuuucucuaccuccuuuuacuugauuucaaucuuccugcaccucgugaagauuccaacacaucgccacauaguagggaaaaguugccccaagccucaucgacugaaccacaugggaaucuguagcugcggccuuuauaagcagccaggugugccggucagauggaaaagguga

SEQ ID NO: 1562 - RNA, 1476 nt, Artificial Sequence
  derived and/or modified CDS sequence (opt3) from Lassa virus__AIT17292__GPC
augggccagaucgugaccuucuuucaagaggucccccacguuauugaagaggugaugaacauaguacugaucgcccucagcauuauggcugugcuuaaggggcuguacaauaucgcaacaugcggauuggucgguuuagugacuuuccugcuacucuguggcagauccugcacgaccacacuguauaaagggguuuacgaacuucagacucuggaguugaacauggaaacccucaauaugacaaugccucugucuuguaccaagaacaauucacaucacuauauuauggugggaaacgagacuggccuggagcucacauuaaccaauacgaguaucauaaaccauaaauuuugcaaucugagcgacgcccacaagaaaaaccuuuacgaucaugcguugauguccaucauuucuacuuuccaccugucgaucccaaauuuuaaccaguaugaagcuaugucaugugacuucaauggugggaagauuagcguccaguacaaccuaagucacuccuaugccggagaugcagccaaucauugcggcaccguggcuaacggcguacuccaaacauuuaugaggauggcauggggagggucuuacaucgcccuggacagcggucacggcgggugggauuguauaaugacuuccuaccaguaucuuauuauccagaacaccacaugggaggaccauugccaguucacccggccgucacccauuggauaccugggcuugcucagucaacgcacgcgagauaucuauaucagccguagacuguuagguacuuuuacauggacccugucugacuccgaagggaaugauacuccuggaggcuacugucucacaagguggaugcuuauugaggcugagcugaagugcuucggcaacaccgccguugcgaaauguaaugaaaagcacgacgaggaauuuugcgauauguugcggcuauucgacuuuaacaaacaggcaauacagcgccugagagccgaggcucagaugucaauccaacucauuaauaaggccgugaacgcacugaucaaugaucagcuuauaaugaaaaaccaccugagggacauuauggggaucccauauugcaauuacagcaaguauugguacuugaaccauacgaccacaggacggaccagucucccccgcuguuggcuggucucuaaugguuccuacuuaaacgaaacucacuucagcgacgauaucgagcagcaagcugacaauaugauuacagagaugcugcagaaggaauauauggagcgacagggcaaaacuccucuagggcucguggaucuguucguguuuucgaccucuuucuaccuuaucuccauauuuuugcaucugauuaagaucccaacacacagacauauugucggaaaacccugcccuaagccacacaggcucaaccacaugggcguuuguucaugcggucuguauaaacagccgggggugcccguacgguggaagcguuga

SEQ ID NO: 1563 - RNA, 1476 nt, Artificial Sequence
  derived and/or modified CDS sequence (opt3) from Lassa virus__AIT17294__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucgaccauaaauuuugcaacuuguccgaugcccacaagaaaaaucuguacgaccaugcgcuaaugucuauaaucucgacguuccaccucucaauuccaaacuuuaaucaguaugaagcuaugagcugugauuucaacggugggaagaucaguguccaguacaaucugucccacucuuaugccggagacgcagccaaccauugcggcacuguggcuaauggcguacuucaaaccuuuaugaggauggcauggggagggagcuacauugcccuggauuccggucggggcgggugggacuguaucaugacaucauaccaguauuugauaauucagaacacuaccugggaggaucacugccaguucagucgcccgagccccguuggauaccucggccuguuaucucaacgaacacgugacaucuauauuuccagaaggcugcucgguaccuuuacguggacucuuucagauagcgaagggaaggacacaccuggaggcuacugucugacccgguggauguugaucgaggcugagcuaaaaugcuucggcaacacugccguggcgaaguguaaugaaaaacaugaugaggaauuuugcgacaugcugcgccucuucgauuuuaacaagcaggcaauccagagacugaaaacagaggcccagaugaguauucaacuuauaaauaaggcugucaacgcccugaucaaugaccaguugauuaugaagaaccaccucagggacaucauggggauaccauauugcaauuacucuaaauauugguaccugaaccacaccacgaccggaaagacauccuuaccccgguguuggcuggugagcaaugguucguaccuaaacgaaacucauuucucugaugacauugagcagcaagcagauaauaugaucaccgagaugcuccagaaagaauauauggagcgccagggcaagacaccucuggggcuuguggacuuguucgucuuuuccacuucauucuaccugaucaguauuuuucuccaccugguuaaaaucccaacccaucgacacauugugggaaagcccugcccuaaaccacauagacuuaaccacaugggcauauguagcugcggucuguauaagcagccggggguacccgugaaguggaaaagguga

SEQ ID NO: 1564 - RNA, 1476 nt, Artificial Sequence
  derived and/or modified CDS sequence (opt3) from Lassa virus__AIT17298__GPC
augggccagaucgugaccuucuuucaagaggucccccacguuauugaagaggugaugaacauaguacugaucgcccucagcauucuugcugugcugaagggguuguacaauaucgcaacaugcggauuacugggucuagucuguuuccuccugcuuugcggcagauccuguacuacgucucuguauaaagggguguacgaauugcagacccucgagcugaacauggaaacacugaauaugacuaugccucucucaugcaccaagaacaauagucaucacuauauuaugguuggaaacgagacaggcuuagagcugacccuuacuaauacaagcaucauaaaccauaaauuuuguaauuuguccgacgcccacaagaaaaaccuguacgaucaugcgcuaaugucuaucauuucgaccuuccaccucucaaucccaaauuuuaaccaguaugaagcuaugagcugcgacuucaauggugggaagauuagugugcaguacaaccugucccacucuuaugccgucgaugcagccagccauuguggaacgaucgcuaauggcgugcuucaaacuuuuaugaggauggcauggggcggguccuacauagcccuggacucaggacacgguggcugggauugcauuaugaccaguuaccaguauuugaucauucagaacacaacuugggaggaccauugucaguucagccggccgucucccaucggguaccucggacuguuaucccaacgcacccgagauaucuauauuucacguagacugcucggcacauuuaccuggacgcuuagcgacagugaagguaaggauacuccugggggauacugccugacaagguggauguugauagaggcugagcuaaaauguuucggcaacaccgccguagcgaagugcaaugaaaaacacgacgaggaauuuugcgauaugcugcgccucuucgacuuuaacaagcaggcaauccagcggcugaaagccgaggcucagaugucuauucaacuuaucaauaaggccguuaacgcacugauaaaugaucaguugauuaugaagaaccaccucagagacaucaugggcaucccauauuguaauuacuccaaauauugguaccugaaccauacuacaaccgggaagacgagcuuacccaaaugcuggcuggugucgaauggaucuuaccuaaacgaaacccacuucuccgacgauauugagcagcaagcugacaauaugaucacagagaugcuccagaaggaauauauggagaggcaggguaaaacuccucugggccuugucgauuuguucguguuuucaaccaguuucuaccugauuagcauauuucuccaucuggugaagaucccaacacaccggcaugucguugggaaacccuguccuaagccacaccgccuuaaccacaugggaauuugcuccuguggccuguauggucagccgggggugcccguaaaguggaaacgauga

SEQ ID NO: 1565 - RNA, 1476 nt, Artificial Sequence
  derived and/or modified CDS sequence (opt3) from Lassa virus__AIT17302__GPC
augggccagaucgugaccuucuuucaagaggucccccacguuauugaagaggugaugaacauaguacugaucgcccucagccuucuggcuguguugaagggguuauacaaugucgcaacaugcggacugauuggucuagugacuuuccuccugcuuuguggcagauccugcacgaccaaccuguauaaagggguuuacgaauugcagacacucgagcugaauauggaaacucugaacaugaccaugccucucucuuguacaaagaauaacucacaucacuauaucauggugggaaaugagaccggcuuagagcugacucuuacaaacaccaguauuaucagccauaaauuuugcaauuuguccgacgcccacaagaaaaaccuguacgaucauacgcuaaugucuauaaucucgacuuuccaccucucaauuccaaauuuuaaccaguaugaagcgaugagcugugacuucaauggugggaagaucaguguccaguacaaccugucccacucuuaugcuguggaugccgcaaaucauugcggaaccguagccaacggcguucuucaaacauuuaugaggauggcuuggggcgggagcuacauugcacuggacuccggacgggguaacugggauuguaucaugacuucauaccaguauuugauaauucagaauaccacaugggaggaccacugccaguucagucgcccgagccccaucggcuaccucgggcuguuaucucaacgaacccgugauauuuauaucuccagaaggcugcucggaacguuuacuuggacacuuucagacagcgaaggcaacgauaccccugguggguacugucugacucgguggauguugaucgaggccgagcuaaagugcuucggaaauacagcuguggccaaauguaacgaaaagcaugacgaggaauuuugcgauaugcugcgccucuucgacuuuaauaaacaggcgauucagagacugaaggcagaggcccagaugaguauacaacuuaucaacaaagcugucaaugcccugauuaacgaucaguugaucaugaagaaucaccucagggacauaaugggcauuccauauugcaacuacucuaaguauugguaccugaaucacaccacgaccggcaaaacauccuuacccaaguguuggcuggugagcaacgggucguaccuaaaugaaacucauuucucugacgauaucgagcagcaagcagacaacaugaucaccgagaugcuccagaaagaauauauggagcggcagggaaagacaccucugggucuuguggauuuguucgucuuuuccacuucauucuaccugauuaguaucuuucuccaccugguuaaaauuccaacccaucgccacauagugggcaagcccugcccuaaaccacaucgacuuaaucacauggggaucuguagcugcggacuguauaagcagccgggcguacccgugagauggaagagguga

SEQ ID NO: 1566 - RNA, 1476 nt, Artificial Sequence
  derived and/or modified CDS sequence (opt3) from Lassa virus__AIT17310__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucaaccauaaauuuugcaauuuguccgacgcccacaagaaaaaccuguacgaucaugcgcuaaugucuauaaucucgacguuccaccucucaauuccaaauuuuaaccaguaugaagcuaugagcugugacuucaauggugggaagaucaguguccaguacaaccugucccacucuuaugccggagaugcagccacucauugcggcaccguggcuaauggcguacuucaaacauuuaugaggauggcauggggagggagcuacauugcccuggacuccggucggggcaagugggauuguaucaugacuucauaccaguauuugauaauucagaacaccacaugggaggaccacugccaguucagucgcccgagccccaucggguaccucggacuguuaucucaacgaacccgugauauuuauaucuccagaaggcugcucggcacguuuacuuggacacuuucagacagcgaagguaaagauaccccugggggauacugucugacucgguggauguugaucgaggcugagcuaaagugcuucggcaacacagccguugcgaaauguaaugaaaagcaugacgaggaauuuugcgauaugcugcgccucuucgacuuuaacaaacaggcaauucagagacugaagaccgaggcccagaugaguauacaacuuaucaauaaggcugugaacgcccugauuaaugaucaguugaucaugaaaaaccaccucagggacauaaugggcauuccauauugcaauuacucuaaguauugguaccugaaccacacgaccacagggaaaacuuccuuaccccgguguuggcuggucagcaauggaucguaccuaaacgaaacccauuucucugacgauaucgagcagcaagcagacaauaugaucacagagaugcuccagaaggaauauauggagcgccaggguaaaacuccucugggccuuguggauuuguucguguuuuccaccucauucuaccugauuaguaucuuucuccaccuggucaagauuccaacacaucgacacauaguugggaaacccugcccuaagccacauagacuuaacuauaugggaaucuguagcugcggccuguacaagcagccgggugugcccguaaaauggaagagguga

SEQ ID NO: 1567 - RNA, 1476 nt, Artificial Sequence
  derived and/or modified CDS sequence (opt3) from Lassa virus__AIT17314__GPC
augggccagaucgugaccuucuuucaagaggucccccacguuauugaagaggugaugaacauaguacugaucacacucagcauucuugccgugcugaagggguuguacaaugucgcuacuugcggauuagugggucugguuacguuccuacuccuguguggcagauccugcaccacaucucuuuauaaagggguguacgaacugcagacuuuggagcucaacauggaaacccugaauaugacaaugccucugucauguaccaagaacaauagucaucacuauaucauggucggaaacgagacuggccucgaguuaacacugaccaauacgagcauuaucaaccauaaauuuugcaaucuuuccgacgcacacaagaaagauuuguacgaccaugcccugaugucuauaaucucgacuuuccaccuaucaauuccaaacuuuaaucaguaugaagcgaugagcugugauuucaacggugggaagaucagugugcaguacaaucucucccacucuuaugcuguagacgccgcaaaccauugcggaaccguugccaauggcgugcugcaaacauuuaugaggauggcuuggggcgggagcuacauugcacuugauuccggacgggguggcugggacuguaucaugacuucauaccaguaucugauaauucagaacaccacaugggaggaucacugccaguucagucgcccgagccccaucggguacuugggacuccugucucaacgaacccgugacauuuauaucuccagaagguuacugggcacguuuacuuggacacucucagauagcgaagguaacgacaccccugggggauacugucuuacucgguggaugcugaucgaggccgaguugaagugcuucggcaauacagcugucgccaaauguaacgaaaagcaugaugaggaauuuugcgacaugcuacgccuguucgauuuuaauaaacaggcgauucagagacucaaggcagaggcccagaugaguauacaacugaucaacaaagcugugaaugcccuuauuaacgaccagcugaucaugaagaaucacuugagggacauaaugggcauuccauauugcaacuacucuaaguauugguaccucaaucacaccacgaccgggaaaacaucccugcccaaguguugguuagugagcaacggaucguaccugaaugaaacucauuucucugaugacaucgagcagcaagcagauaacaugaucaccgagaugcuacagaaagaauauauggagcggcaggguaagacaccucucggccuggucgaccuuuucguguuuuccacuucauucuacuugauuaguaucuuucugcaccucguuaaaauuccaacccaucgccacauaguagggaagcccugcccuaaaccacaucgacugaaucacaugggaaucuguagcugcggccuuuauaagcagccgggugugcccgucaaguggaaaagauga

SEQ ID NO: 1568 - RNA, 1476 nt, Artificial Sequence
  derived and/or modified CDS sequence (opt3) from Lassa virus__AIT17318__GPC
augggccagaucgugaccuucuuucaagaggucccccacguuauugaagaggugaugaacauaguacugaucgcccucagccuucuggcuguguugaagggguuauacaaugucgcaacaugcggacugauuggucuagugacuuuccuccugcuuuguggcagauccugcacgaccaaccuguauaaagggguuuacgaauugcagacacucgagcugaauauggaaacucugaacaugaccaugccucucucuuguacaaagaauaacucacaucacuauaucauggugggaaaugagaccggcuuagagcugacucuuacaaacaccaguauuaucaaucauaaauuuugcaacuugagcgacgcccacaagaaaaaucuguacgaucaugcgcuaauguccauaaucucuacguuccaccucucgauuccaaacuuuaaucaguaugaagcuaugucaugugacuucaacggugggaagaucagcguccaguacaaucugagucacuccuaugccguggaugcagccaaccauugcggaacuguagcuaacggcguucuucaaaccuuuaugaggauggcauggggcgggucuuacauugcccuggacagcggacgggguaauugggauuguaucaugacauccuaccaguauuugauaauucagaacaucacuugggaggaccacugccaguucucacgcccgagucccauuggcuaccucgggcuguuaagccaacgaacccgugauaucuauaucucuagaaggcugcucggaacauuuaccuggacgcuuuccgacucagaaggcaaugauacuccugguggguacugucugacacgguggauguugauugaggcugagcuaaagugcuucggaaacaccgccguggcgaaauguaaugaaaagcaugacgaggaauuuugcgauaugcugcgccucuucgacuuuaacaaacaggcaauacagagacugaaggccgaggcucagaugagcauccaacuuauuaauaaagccgucaacgcacugaucaaugaucaguugauaaugaagaaccaccucagggacauuaugggcaucccauauugcaauuacaguaaguauugguaccugaaccacacuacaaccggcaaaacgucuuuacccaaguguuggcugguguccaaugggagcuaccuaaacgaaacccauuucucggacgauaucgagcagcaagcugacaauaugauuacagagaugcuccagaaagaauauauggagcggcagggaaagacuccucugggucuuguggauuuguucgucuuuucuaccuccuucuaccugaucucaauuuuucuccaccugguuaaaauaccaacacaucgccacaucgugggcaagcccugcccuaaaccacaucgacuuaaccacauggggauuuguaguugcggacuguauaagcagccgggcguacccgugagauggaagagguga

SEQ ID NO: 1569 - RNA, 1476 nt, Artificial Sequence
  derived and/or modified CDS sequence (opt3) from Lassa virus__AIT17322__GPC
augggccagaucgugaccuucuuucaagaggucccccacguuauugaagaggugaugaacauaguacugaucgcccucagccuucuggcuguguugaagggguuauacaaugucgcaacaugcggacugauuggucuagugacuuuccuccugcuuuguggcagauccugcacgaccaaccuguauaaaggggccuacgaauugcagacacucgagcugaauauggaaacucugaacaugaccaugccucucucuuguacaaagaauaacucacaucacuauaucaugguuggaaaugagaccggcuuagagcugacucuuacaaacaccaguauuaucaaucauaaauuuugcaacuugagcgacgcgcacaagaaaaaucuguacgaucauacgcuaauguccauaaucucuacuuuccaccucucgauuccaaacuuuaaucaguaugaagcuaugucaugugacuucaacggugggaagaucagcgugcaguacaaucugagucacuccuaugccgucgaugcagccaaccauugcggaaccguggcuaacggcguacuucaaacauuuaugaggauggcauggggcgggucuuacauugcccuggacagcggacgggguaauugggauuguaucaugacuuccuaccaguauuugauaauucagaacaccacaugggaggaccacugccaguucucacgcccgagucccaucggcuaccucgggcuguuaagccaacgaacccgugauauuuauaucucuagaaggcugcucggaacguuuacuuggacacuuuccgacucagaaggcaaugauaccccugguggguacugucugacucgguggauguugaucgaggcugagcuaaagugcuucggaaacacagccguugcgaaauguaaugaaaagcaugacgaggaauuuugcgauaugcugcgccucuucgacuuuaacaaacaggcaauucagagacugaaggccgaggcucagaugagcauacaacuuaucaauaaagccgugaacgcacugauuaaugaucaguugaucaugaagaaccaccucagggacauaaugggcauuccauauugcaauuacaguaaguauugguaccugaaccacaccacgaccggcaaaacaucuuuacccaaguguuggcuggucuccaaugggagcuaccuaaacgaaacucauuucucggacgauaucgagcagcaagcugacaauaugaucaccgagaugcuccagaaagaauauauggagcggcagggaaagacaccucugggucuuguggauuuguucguguuuucuacuuccuucuaccugauuucaaucuuucuccaccuggucaaaauuccaacccaucgccacauaguuggcaagcccugcccuaaaccacaucgacuuaaccacauggggaucuguaguugcggacuguauaagcagccgggcgugcccguaagauggaagagguga

SEQ ID NO: 1570 - RNA, 1476 nt, Artificial Sequence
  derived and/or modified CDS sequence (opt3) from Lassa virus__AIT17328__GPC
augggccagaucgugaccuucuuucaagaggucccccacguuauugaagaggugaugaacauaguacugaucacacucagcauucuugccgugcugaagggguuguacaauaucgcuacuugcggauuagucggucuggugacguuccuacuccuguguggcaaauccugcaccacaucucuuuauaaggggguuuacgaacugcagacuuuggagcucaacauggaaacccugaauaugacaaugccucugucauguaccaaaaacaauagucaucacuauauuagagugggaaacgagacuggccucgaguuaacacugaccaauacgagcaucauaaaccauaaguuuugcaaucuuuccgacgcacacaaaaagaacuuguacgaucaugcccugaugucuaucauuucgacuuuccaccuaucaaucccaaauuuuaaccaguaugaagcgaugagcugugacuucaauggugggaagauuaguguccaguacaaccucucccacucuuaugcuguggaugccgcaaaucauugcggaaccguagccaacggcguucugcaaacauuuaugaggauggcuuggggcgggagcuacaucgcacuugacuccggacacgguaacugggauuguauaaugacuucauaccaguaucugauuauccagaauaccacaugggaggaccauugccaguucagucggccgagccccauuggcuacuuggggcuccugucucaacgcacccgagauaucuauaucucccguagauuacugggaacguuuacuuggacacucucagacagcgaaggcaacgaugccccugguggguacugucuuaccagguggaugcugauugaggcugaguugaaaugcuucggaaauacugccguggcgaaguguaacgaaaaacacgacgaggaauuuugcgauaugcuacggcuguucgacuuuaauaagcaggcaauacagcgccucaaagccgaggcucagaugaguauccaacugauuaacaaggccgucaaugcacuuaucaacgaucagcugauaaugaagaaucacuugagagacauuaugggcaucccauauugcaacuacucuaaauauugguaccucaaucauacaaccacgggcaagaccucccugcccaaauguugguuagugagcaacgggucguaccugaaugaaacacacuucucugacgauaucgagcagcaagcugacaacaugauuacugagaugcuacagaaggaauauauggagaggcagggaaaaaccccucucggucugguggaucuuuucgucuuuuccacaucauucuacuugaucaguauuuuucugcaucucguuaagauaccaacucaccggcaugugguaggcaaaagcugccccaagccucaccgccugaaucacauggggaucuguuccugcggacuuuauaagcagccaggcgugccggucaaauggaagcgauga

SEQ ID NO: 1571 - RNA, 1476 nt, Artificial Sequence
  derived and/or modified CDS sequence (opt3) from Lassa virus__AIT17332__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucagggugggaaacgagaccggcuuagagcugacucuuacaaauaccagcauuaucaaccauaaauuuugcaauuuguccgacgcccacaagaaaaaccuguacgaucaugcgcuaaugucuauaaucucgacguuccaccucucaauuccaaauuuuaaccaguaugaagcuaugagcugugacuucaauggugggaagaucaguguccaguacaaccugucccacucuuaugccguggaugcagccaaucauugcggaacuguagcuaacggcguucuucaaaccuuuaugcggauggcauggggcgggagcuacauugcccuggacuccggacacggucgcugggauuguaucaugacaucauaccaguauuugauaauucagaacacuaccugggaggaccauugccucuucagucgaccgagccccaucggcuaccugggguuacugucucagcguacaagagauauuuauaucuccaggcggcuccuuggaaccuuuacguggacucugucagacagcgaaggccgcgauacaccugguggguacuguuugaccagauggaugcuaaucgaggcugagcugaagugcuucggaaauacugccguggcgaaauguaacgaaaagcacgacgaggaauuuugcgauaugcucaggcuguucgacuuuaauaaacaagcaauucagcggcuuaaggccgaggcucagaugaguauacagcugaucaacaaagccgucaaugcauugauuaacgaucaacucaucaugaagaaucaucugcgcgacauaaugggcauuccauauugcaacuacucuaaguauugguacuuaaaucacacaaccacgggccgaaccucccugcccagauguuggcuagugagcaacgggucguaccucaaugaaacacacuucucugacgauaucgagcagcaggcugacaacaugaucacugagaugcugcaaaaagaauauauggagaggcagggaaagaccccucuugguuugguggaucuguucgucuuuuccacaucauucuaccucauuaguaucuuucugcaucuuguuaaaauuccaacucaccggcauauagugggcaagagcugccccaaaccucaccgucugaaucacauggggaucuguuccugcggauuguauaagcagccaggcguaccggugaaauggaagcgcuga

SEQ ID NO: 1572 - RNA, 1476 nt, Artificial Sequence
  derived and/or modified CDS sequence (opt3) from Lassa virus__AIT17340__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauauuagcaucauaaaccauaaauucugcaaucuuuccgacgcccacaagaaaaacuuguacgaucaugcgcugaugucuaucauuucgaccuuucaccuaucaaucccaaauuucaaccaguaugaagcuaugagcugugacuuuaauggugggaagauuaguguccaguacaaccucucccacucuuaugccggagaugcagccaaucauugcggcacgguggcuaacggcguacugcaaacuuucaugaggauggcauggggagggagcuacaucgcccuugacuccggucggggcgagugggauuguauaaugaccucauaccaguaucugauuauccagaacacaacuugggaagaccacugccaguuuagucgcccgagccccauuggguacuugggacuccugucucaacgaacccgugauaucuauaucuccagaagguuacugggcacauucaccuggacgcucucagacagcgaggguaaggauacuccugggggauacugucuuacacgguggaugcugauugaggcugaauugaaaugcuuuggcaauaccgccguugcgaaguguaacgagaaacaugacgaagaguucugcgauaugcuacgccuguuugacuucaauaagcaggcaauacagagacucaaagccgaagcucagaugaguauccaacugauuaacaaggccgugaaugcacuuaucaacgaucagcugauaaugaagaaucacuugagggacauuaugggcaucccauauugcaacuacucuaaauauugguaccucaaucacacuacaaccgggaagacgucccugcccaaauguugguuagucagcaacggaucguaccugaaugagacccauuucucugacgauaucgagcagcaagcugacaacaugauuacagaaaugcuacagaaggaguauauggaacggcaggguaaaacuccucucggccugguggaucuuuuuguguucuccaccucauuuuacuugaucaguauuuuccugcaccucgucaagauaccaacacaucgccacaucguugggaaacccugcccucgaccacauagacugaaucacaugggaauuuguagcugcggccuuuauaagcagccgggugugcccguaaaguggaaaagguga

SEQ ID NO: 1573 - RNA, 1476 nt, Artificial Sequence
  derived and/or modified CDS sequence (opt3) from Lassa virus__AIT17344__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacaaucaugcgcugaugucuauaaucucgacguuucaccuaucaauuccaaacuucaaucaguaugaagcuaugagcugugauuuuaacggugggaagaucaguguccaguacaaucucucccacucuuaugccggagacgcagccagccauugcggcacuguggcuaacggcguacugcaaaccuucaugaggauggcauggggaggguccuacauugcccuugauucagguuacggcaagugggacuguaucaugacaaguuaucaguaccugauaauucagaacacuaccugggaggaucacugccaguuuagccggccgucucccaucggguauuugggacuccugucccaacgcacacgagacauuuacaucucacguagauuacugggcaccuucacguggacucucagcgauagugaagguaaagacacaccugggggauauugucuuaccagguggaugcugaucgaggcugaguugaagugcuuuggcaauacugccguugcgaaauguaacgaaaagcaugaugaggaguucugcgacaugcuacggcuguuugauuucaauaaacaggcaauucagcgccucaagacagaagcccagaugucuauacaacugaucaacaaggcugugaaugcccuuauuaacgaccagcugaucaugaaaaaucacuugagagauauaaugggcauuccauacugcaacuauuccaaguacugguaccucaaucacaccacgaccgggaaaacaagccugcccaaguguugguuagucucgaacggaucuuaucugaaugaaacucauuucuccgacgacaucgagcagcaagcagauaacaugaucaccgagaugcuacagaaagaauacauggagaggcaggguaagacaccucucggccugguggaccuuuuuguguucucaaccaguuuuuauuugauuagcaucuuccugcaccucgucaaaauuccaacucaucggcacauaguugggaaguccugccccaagccucaucgccugaaucacaugggaaucuguucuugcggccuuuacaaacagccaggugugccgguacgauggaagagauga

SEQ ID NO: 1574 - RNA, 1476 nt, Artificial Sequence
  derived and/or modified CDS sequence (opt3) from Lassa virus__AIT17348__GPC
augggccagaucgugaccuucuuucaagaggucccccacguuauugaagaggugaugaacauaguacugaucgcccucagcauucuugcugugcugaagggguuguacaauaucgcaacaugcggauuaauuggucuggucacuuuccuacuccuguguggcagauccugcacgaccucucuuuauaaagggguguacgaacugcagacauuggagcucaacauggaaacucugaauaugaccaugccucugucauguacaaagaacaauagucaucacuauaucaugguuggaaacgagaccggccucgaguuaacucugacaaauaccagcauaaucaaccauaaauuuugcaaucuuuccgacgcccacaagaaaaacuuguacgaucaugcgcugaugucuauuaucucgacguuccaccuaucaauuccaaauuuuaaccaguaugaagcuaugagcugugacuucaauggugggaagaucagugugcaguacaaccucucccacucuuaugccggagaugcagccaaucauugcggcacugucgcuaacggcgugcugcaaaccuuuaugaggauggcauggggagggagcuacauagcccuugacuccggucggggccgcugggauuguauuaugacaucauaccaguaucugaucauucagaacacuaccugggaggaccacugccaguucagucgaccgagccccaucggguacuugggacuccugucucaacguacaagagauaucuauauuuccaggcgguuacugggcaccuuuacguggacucucucagacagcgaagguaaugauacaccugggggauacugucuuacccgcuggaugcugauagaggcugaguugaagugcuucggcaacacugccguagcgaaauguaaugaaaagcaugacgaggaauuuugcgauaugcuaagacuguucgacuuuaacaaacaggcaauccagaggcucaaggccgaggcucagaugaguauucaacugaucaauaaagccguuaacgcacuuauaaaugaucagcugauuaugaagaaccacuugcgggacaucaugggcaucccauauugcaauuacucuaaguauugguaccucaaccacacaaccacggggaaaaccucccugcccaaguguugguuagugagcaauggaucguaccugaacgaaacacauuucucugacgauauugagcagcaagcugacaauaugaucacugagaugcuacagaaagaauauauggagcgccaggguaagaccccucucggccuggucgaucuuuucguguuuuccacaucauucuacuugauuaguauauuucugcaccucgugaaaaucccaacucaucgacacauugucgggaagcccugcccuaaaccacauagacugaaccacaugggaaucuguagcugcggccuuuauaagcagccggguguucccgugaaguggaaaagguga

SEQ ID NO: 1575 - RNA, 1476 nt, Artificial Sequence
  derived and/or modified CDS sequence (opt3) from Lassa virus__AIT17350__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuacuccuguguggcagauccugcacgaccacacuuuauaaagggguuuacgaacugcaggccuuggagcucaacauggaaacucugaauaugaccaugccucugucuuguacaaagaacaauucacaucacuauauuauggugggaaacgagaccggccucgaguuaacucugacaaauaccaguaucauagaccauaaauuuugcaaccuuagcgaugcgcacaagaaaaauuuguacgaccaugcucugauguccaucauuucuacguuccaccuaucgaucccaaacuuuaaucaguaugaagccaugucaugugauuucaacggugggaagauuagcguccaguacaaucucagucacuccuaugcaggagacgccgcuaagcauugcggcacuguggcaaacggcguacugcaaaccuuuaugaggauggccuggggagggucuuacaucgcucuugauagcggucggaauggcugggacuguguuaugacauccuaccaguaucugauaauucagaacacuaccugggaggaucacugccaguucucacgcccgagucccaucggguacuugggacuccugagccaacgaacacgugacauuuauaucucuagaagguuacugggcaccuuuacguggacucucuccgauucagaagguaaagacacaccugggggauacugucuuacccgguggaugcugaucgaggccgaguugaagugcuucggcaacacugcgguggcaaaauguaaugaaaagcaugaugaggaauuuugcgacaugcuacgccuguucgauuuuaacaaacaggccauucagagacucaagacagaggcucagaugagcauacaacugaucaauaaggccgucaacgcacuuauuaaugaccagcugaucaugaaaaaccacuugagggacauaaugggcauuccauauugcaauuacaguaaguauugguaccucaaccacaccgugacggggaaaaccucucugccccgguguugguuaguguccaauggaagcuaccugaacgaaacacauuucucggaugacaucgagcagcaagcugauaauaugaucacugagaugcuacagaaggaauauauugagcgccaggguaaaaccccucucggccuggucgaccuuuucguguuuucuacauccuucuacuugaucucaauuuuucugcaccucguuaagauaccaacucaucgacacaucauugggaaacccugcccuaagccacauagacugaaccacaugggaaucuguaguugcggccuuuauaagcagccggguguacccgugagguggaaacgguga

SEQ ID NO: 1576 - RNA, 1476 nt, Artificial Sequence
  derived and/or modified CDS sequence (opt3) from Lassa virus__AIT17354__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauauuagcaucauaaaccauaaauucugcaaucuuuccgacgcccacaagaaaaacuuguacgaucaugcgcugaugucuaucauuucgaccuuucaccuaucaaucccaaauuucaaccaguaugaagcuaugagcugugacuuuaauggugggaagauuaguguccaguacaaccucucccacucuuaugccggagaugcagccaaucauugcggcacgguggcuaacggcguacugcaaacuuucaugaggauggcauggggagggagcuacaucgcccuugacuccggucacggcgggugggauuguauaaugaccucauaccaguaucugauuauccagaacacaacuugggaggaccauugccaguuuagucggccgagccccauuggauacuugggccuccugucucaacgcacccgagauaucuauaucucccguagauuacuggguacauucaccuggacgcucucagacagcgaagggaaggauacuccuggaggcuacugucuuacaagguggaugcugauugaggcugaguugaaaugcuuuggcaauaccgccguugcgaaguguaacgaaaaacacgacgaggaguucugcgauaugcuacggcuguuugacuucaauaagcaggcaauacagcgccucaaagccgaagcucagaugaguauccaacugauuaacaaggccgugaaugcacuuaucaacgaucagcugauaaugaagaaucacuugagagacauuauggggaucccauauugcaacuacucuaaauauugguaccucaaucauacuacaaccggaaagacgucccugcccaaauguugguuagucagcaacgguucguaccugaaugaaacccacuucucugacgauaucgagcagcaagcugacaacaugauuacagagaugcuacagaaggaauauauggagaggcagggcaaaacuccucucgggcugguggaucuuuuuguguucuccaccucauuuuacuugaucaguauuuuccugcaucucgucaagauaccaacacaccggcauaucguuggaaaacccugcccucgcccacaccgacugaaucacaugggcauuuguagcugcggucuuuauaagcagccgggggugcccguaaaguggaaaagauga

SEQ ID NO: 1577 - RNA, 1476 nt, Artificial Sequence
  derived and/or modified CDS sequence (opt3) from Lassa virus__AIT17360__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucagggugggaaacgagaccggccucgaguuaacucugacaaauaccagcauuaucaaccaucgguucugcaaucuuuccgacgcccacaaaaagaacuuguacgaucaugcgcugaugucuauaaucucgacguuucaccuaucaauuccaaauuucaaccaguaugaagcuaugagcugugacuuuaauggugggaaaaucaguguccaguacaaccucucccacucuuaugccggagaugcagccaaucauugcggcacuguggcuaacggcguacugcaaaccuucaugcgcauggcauggggagggagcuacauugcccuugacuccggucacggcaagugggauuguaucaugacaucauaccaguaucugauaauucagaacacuaccugggacgaucauugccaguuuagucgaccgagccccaucggguacuugggacuccugucucaacguacaagagacauuuauaucuccaggcgguuacugggcaccuucacguggacucucucagauagcgaggguaaggacacaccugggggauacugucuuacccgcuggaugcugaucgaagcugaguugaaaugcuuuggcaauacugccguugcgaaguguaacgagaaacacgaugaagaguucugcgacaugcuaagacuguuugauuucaauaagcaggcaauuaggcggcucaaagccgaagcucagaugaguauacagcugaucaacaaggccgugaaugcacuuauuaacgaccaacugaucaugaagaaucacuugcgcgacauaaugggcauuccauauugcaacuacucuaaauauugguaccucaaucauacaaccacggggaagaccucccugccccgauguugguuagucagcaacggaucguaccugaaugagacacacuucucugaugacaucgaacagcaggcugauaacaugaucacugagaugcuacaaaaagaguauauggaaagacaggguaagaccccucucggccugguggaccuuuuuguguucuccacaucauuuuacuugauuaguaucuuccugcaucucgucaaaauuccaacucacaggcauauaguuggaaagagcugccccaaaccucaccggcugaaucacauggggaucuguuccugcggcuuuuauaagcagccaggugugccgguaaaguggaaacguuga

SEQ ID NO: 1578 - RNA, 1476 nt, Artificial Sequence
  derived and/or modified CDS sequence (opt3) from Lassa virus__AIT17364__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccggagaugcagccaaucauugcggcacuguggcuaacggcguacugcaaaccuucaugaggauggcauggggagggagcuacauugcccuugacuccggucgggaucgcugggacuguaucaugacaucauaccaguaucugauaauucagaacacuaccugggaggaucacugccaguuuagucgaccgagccccaucggcuacuuggggcuccugucucaacguacaagagacauuuauaucuccaggcgguuacugggaaccuucacguggacucucucagauagcgaaggcaaggacacaccugguggguacugucuuacccgcuggaugcugaucgaggcugaguugaaaugcuuuggaaauacugccguugcgaaguguaacgaaaaacaugaugaggaguucugcgacaugcuaagacuguuugauuucaauaagcaggcaauucagaggcucaaagccgaagcucagaugaguauacaacugaucaacaaggccgugaaugcacuuauuaacgaccagcugaucaugaagaaucacuugcgggacauaaugggcauuccauauugcaacuacucuaaauauugguaccucaaucacacaaccacgggcaagaccucccugcccaaauguugguuagucagcaacgggucguaccugaaugaaacacauuucucugaugacaucgagcagcaagcugauaacaugaucacugagaugcuacagaaggaauauauugagcgccagggaaaaaccccucucggucugguggaccuuuuuguguucuccacaucauuuuacuugaucaguauuuuccugcaccucgucaagauaccaacucaucgacacaucguuggcaaacccugcccuaagccacauagacugaaucacauggggauuuguagcugcggacuuuauaagcagccgggcguguccguaaaauggaagagguga

SEQ ID NO: 1579 - RNA, 1476 nt, Artificial Sequence
  derived and/or modified CDS sequence (opt3) from Lassa virus__AIT17368__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguuugaagcuaugagcugugacuucaauggugggaagaucaguguccaguauaaccucucccacucuuacgccggagaugcagccaaucauugcggcacuguggcuaacggcguacugcaaaccuuuaugaggauggcauggggagggagcuauauugcccuugacuccggucacucaaagugggauuguaucaugacaaguuaccaguaccugauaauucagaacacuaccugggacgaucauugccaguucagccggccgucucccaucggcuauuuggggcuccugucccaacgcacacgagacauuuacaucucacguagauuacugggaaccuuuacguggacucucagcgauagugagggcaaagacacaccugguggguauugucuuaccagguggaugcugaucgaagcugaguugaagugcuucggaaauacugccguugcgaaauguaacgagaagcacgaugaagaguuuugcgacaugcuacggcuguucgauuucaauaaacaggcaauucagcgccucaaggccgaagcucagaugucuauacaacugaucaacaaggccgugaaugcacuuauuaacgaccagcugaucaugaaaaaucacuugagagacauaaugggcauuccauacugcaacuauuccaaguacugguaucucaaucauacaaccacgggcaaaaccagccugcccaaguguugguuagucucgaacgggucuuaccugaaugagacacacuuuuccgaugacaucgaacagcaagcugauaacaugaucacugagaugcuacagaaagaguacauggaaaggcagggaaagaccccucucggucugguggaccuuuucguguuuucaacaaguuucuauuugauuagcaucuuucugcaucucgucaaaauuccaacucaccggcauauaguuggcaaguccugccccaagccucaccgccugaauuacauggggaucuguucuugcggauucuauaaacagccaggcgugccgguaaaguggaaacgauga

SEQ ID NO: 1580 - RNA, 1476 nt, Artificial Sequence
  derived and/or modified CDS sequence (opt3) from Lassa virus__AIT17370__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccggagaugcagccaaucauugcggcacuguggcuaacggcguacugcaaaccuucaugaggauggcauggggagggagcuacauugcccuugacuccggucgggaucgcugggacuguaucaugacaucauaccaguaucugauaauucagaacacuaccugggaggaucacugccaguuuagucgaccgagccccaucggcuacuuggggcuccugucucaacguacaagagacauuuauaucuccaggcgguuacugggaaccuucacguggacucucucagauagcgaaggcaaggacacaccugguggguacugucuuacccgcuggaugcugaucgaggcugaguugaaaugcuuuggaaauacugccguugcgaaguguaacgaaaaacaugaugaggaguucugcgacaugcuaagacuguuugauuucaauaagcaggcaauucagaggcucaaagccgaagcucagaugaguauacaacugaucaacaaggccgugaaugcacuuauuaacgaccagcugaucaugaagaaucacuugcgggacauaaugggcauuccauauugcaacuacucuaaauauugguaccucaaucacacaaccacgggcaagaccucccugcccaaauguugguuagucagcaacgggucguaccugaaugaaacacauuucucugaugacaucgagcagcaagcugauaacaugaucacugagaugcuacagaaggaauauauggagcgccagggaaaaaccccucucggucugguggaccuuuuuguguucuccacaucauuuuacuugauuaguaucuuccugcaccucgucaagauuccaacucaucgacacauaguuggcaaacccugcccuaagccacauagacugaaucacauggggaucuguagcugcggacuuuauaagcagccgggcguguccguaaaauggaagagguga

SEQ ID NO: 1581 - RNA, 1476 nt, Artificial Sequence
  derived and/or modified CDS sequence (opt3) from Lassa virus__AIT17378__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucaaccauaaauuuugcaauuuguccgacgcccacaagaaaaaccuguacgaucauacgcuaaugucuauaaucucgacuuuccaccucucaauuccaaauuuuaaccaguaugaagcgaugagcugugacuucaauggugggaagaucaguguccaguacaaccugucccacucuuaugcuguggaugccgcaaaucauugcggaaccguagccaacggcguucuucaaacauuuaugaggauggcuuggggcgggagcuacauugcacuggacuccggacggucagguugggauuguaucaugacuucauaccaguauuuggugauacagaacaccacaugggaggaccacugccaguucagccgcccgucucccauuggcuaccucgggcuguuaucccaacgaacccgugauaucuauauuucaagaaggcugcucggaacguuuacuuggacacuuagcgacagugaaggcaagaauaccccugguggguacugucugacucgguggauguugaucgaggccgagcuaaaaugcuucggaaacacagcugucgccaaguguaaugaaaaacaugaugaggaauuuugcgacaugcugcgccucuucgauuuuaacaagcaggcgauccagagacugaaagcagaggcccagaugucuauucaacuuauaaauaaggcugugaacgcccugaucaaugaccaguugauuaugaagaaccaccucagggauaucaugggcauaccauauugcaauuacuccaaauauugguaccugaaccacaccacgaccggccggacuagcuuaccccgcuguuggcuggugucgaaugggucuuaccuaaacgaaacucauuucuccgacgacauugagcagcaagcagauaauaugaucaccgagaugcuccagaaggaauauauggagcgacagggaaaaacaccucugggucuugucgacuuguucguuuuuaguacaaguuucuaccugaucagcauuuuucuccaccuggugaagaucccaacccauagacacauuguaggcaaauccugccccaagccucauaggcuuaaccacauggggauauguucuugcggauucuauaaacagccaggcgugccggucaaguggaagcgguga

SEQ ID NO: 1582 - RNA, 1476 nt, Artificial Sequence
  derived and/or modified CDS sequence (opt3) from Lassa virus__AIT17388__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuacuccuguguggcagauccugcacgaccacacuuuauaaagggguuuacgaacugcaggccuuggagcucaacauggaaacucugaauaugaccaugccucugucuuguacaaagaacaauucacaucacuauauuagggugggaaacgagaccggccucgaguuaacucugacaaauaccaguaucauaaaccauaaauuuugcaaucuuagcgacgcgcacaagaaaaacuuguacgaucaugcucugauguccaucauuucuacguuccaccuaucgaucccaaauuuuaaccaguaugaagccaugucaugugacuucaauggugggauuaucagcguccaguacaaccucagucacuccuaugcaggagaugccgcuaaucauugcggcacuguggcaaacggcguacugcaaaccuuuaugcggauggccuggggagggucuuacauagcucuugacagcggucgcaacggcugggauuguauuaugacauccuaccaguaucugaucauucagaauacuaccugggacgaucacugccaguucucacgaccgagucccaucggguacuugggacuccugagccaacguacaagagacaucuauauuucuaggcgguuacugggcaccuuuacguggacucucuccgauucagaggguaaggacacaccugggggauacugucuuacccgcuggaugcugauagaagccgaguugaagugcuucggcaacacugcgguugcaaaauguaaugagaagcaugaugaagaguuuugcgacaugcuaagacuguucgauuuuaacaaacaggccauccagaggcucaagacagaagcucagaugaauauucaacugaucaacaaagccgugaaugcacuuauaaacgaccagcugauuaugaagaaucacuugcgggacaucaugggcaucccauauugcaacuacagcaaguauugguaccucaauaacaccgcuacggggaaaaccagucugccccgcuguugguuagucucuaauggauccuaccugaacgagacacacuucagcgaugacauugaacagcaagccgauaauaugaucacugagaugcuacagaaggaguauauggaacgacaggguaaaaccccucucggccugguggaccuuuucguguuuucgacaucuuucuacuugauuuccauauuucugcaucucgucaagaucccaacucacagacauauuguugggaaacccugcccuaagccacacaggcugaaccauaucggaaucuguucaugcggccuuuauaaacagccgggugugcccguaaaguggaagcgguga

SEQ ID NO: 1583 - RNA, 1473 nt, Artificial Sequence
  derived and/or modified CDS sequence (opt3) from Lassa virus__AIT17404__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaguugggacuguaucaugacuagcuaccaguaucuuauuauccagaacaccacaugggaagaucacugccaguuuucucggccgucccccaucggcuaccugggguugcucucacaacgcacucgagacauuuauauaagccguagacuguuaggaaccuucacauggacccugagugauucugagggcaacgaaacgccugguggguacugucucacuagguggaugcuuaucgaggcggagcugaaaugcuuuggaaauacagcaguggccaaguguaacgaaaaacaugacgaggaguucugcgauauguugcggcuauuugacuucaauaagcaggcuauucgcagacugaaaaccgaagcccagauguccauccagcucauaaacaaggcaguaaaugcucugauuaacgaucaacuuaucaugaagaaucaccugagggacaucaugggcauuccauauugcaacuacagcaaauauugguacuugaaucacacuguuacaggcaagaccucgcucccccgguguuggcuggugucuaacggguccuacuuaaaugaaacgcauuucucagacgauaucgagcagcaggccgacaacaugauuaccgagcugcuacaaaaagaauauauggaucgccagggaaagacaccucucggucuggucgaccuuuuuguguucaguacuagcuuuuacuugauauccaucuuccugcaccucauuaaaaucccaacccaucgacacaucacaggcaagcccugcccuaaaccacauagacugaaucacauggggauuuguucuugcggacuuuauaagcacccgggcgugcccgucaaguggaaaagguga

SEQ ID NO: 1584 - RNA, 1473 nt, Artificial Sequence
  derived and/or modified CDS sequence (opt3) from Lassa virus__AIT17408__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacggucgcaaauggcgugcuccaaacuuucaugaggauggccuggggcggguccuacauagcucuggauucaggaaaggguaguugggacuguauuaugaccagcuaccaguaucuuaucauucagaacacaacuugggaagaucacugccaguuuucucggccgucccccaucggcuaccugggguugcucucacaacgcacccgagacaucuauauuagccguagacuguuaggaacauucaccuggacgcugagugauucugagggcaacgaaacuccugguggguacugucucacaagguggaugcuuauagaggccgagcugaaaugcuuuggaaauaccgcgguagcaaaguguaacgaaaaacaugacgaggaguucugcgauauguugcggcuauuugacuucaauaagcaggccauccgcagacugaaaacugaagcucagauguccauucagcucaucaacaaggccguuaaugcacugauaaacgaucaacuuauuaugaagaaucaccugagggacaucaugggcaucccauauugcaacuacagcaaauauugguacuugaaucacacagugaccggcaagacgucgcucccccgguguuggcuggucucuaacggguccuacuuaaaugaaacccauuucucagacgauauugagcagcaggcugacaacaugaucacagagcugcuacaaaaagaauauauggaucgccagggaaagacuccucucggucugguggaccuuuuuguguucaguaccagcuuuuacuugauuuccauauuccugcaccucgucaaaaucccaacacaucgacacguuauuggcaagcccugcccuaaaccacauagacugaaucacauggggaucuguucuugcggacuuuauaagcacccgggcgugcccguaaaguggaaaagguga

SEQ ID NO: 1585 - RNA, 1473 nt, Artificial Sequence
  derived and/or modified CDS sequence (opt3) from Lassa virus__AIT17412__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaguugggacuguaucaugacuagcuaccaguaucuuauuauccagaacaccucuugggaagaucacugccaguuuucccggccgucacccaucggcuaccugggguugcucagccaacgcacacgagacauuuauauaagucguagacuguuaggaacuuucaccuggacacugucugauuccgagggcaacgaaaccccugguggguacugucucacgagguggaugcuuaucgaggcggagcugaaaugcuuuggaaauacugcaguggccaaguguaacgaaaaacaugacgaggaguucugcgauauguugcggcuauuugacuucaauaagcaggcuauucgcagacugaaaacagaagcccagaugagcauccagcucauaaacaaggcaguaaaugcucugauuaacgaucaacuuaucaugaagaaucaccugagggacaucaugggcauuccauauugcaacuacucgaaauauugguacuugaaucacaccguuacuggcaagacaucucucccccgguguuggcugguguccaacgggucauacuuaaaugaaacccauuucagugacgauaucgagcagcaggccgacaacaugauuacggagcugcuacaaaaagaauauauagaucgccagggaaagaccccucucggucuggucgaccuuuuuguguucagcacauccuuuuacuugaucucuauuuuccugcaccucgugaaaaucccaacucaucgacacgucaucggcaagcccugcccuaaaccacauagacugaaucacauggggauuuguagcugcggacuuuauaagcacccgggcguucccgugaaguggaaaagguga

SEQ ID NO: 1586 - RNA, 1473 nt, Artificial Sequence
  derived and/or modified CDS sequence (opt3) from Lassa virus__AIT17416__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaggaagaaucuuuacgaccaugcuuugaugucaauuaucagcacauuucaccugaguauuccaaacuucaaucaguaugaggccauguccugugauuuuaacggugggaaaaucucuguucaguacaaucuaagccacgcauaugccguggacgcugcaaaccauugcggaaccauagccaauggcguccuccaaacguucaugcggauggcuuggggcggguccuacauugcccuggauucaggaaaggguaguugggacuguaucaugacuagcuaccaguaucuuauuauccagaacaccucuugggaagaucacugccaguuuucccgcccgucacccaucggcuaccugggguugcucagccaacgaacacgugacauuuauauaaguagaaggcuguuaggaacuuucaccuggacacugucugauuccgagggcaacgaaaccccugguggguacugucucacgcgguggaugcuuaucgaggcggagcugaagugcuuuggaaauacugcaguggccaaauguaacgaaaagcaugacgaggaguucugcgauauguugcgccuauuugacuucaauaaacaggcuauuagaaggcugaagacagaagcccagaugagcauccagcucauaaacaaagcaguaaaugcucugauuaacgaucaacuuaucaugaagaaucaucugcgggacaucaugggcauuccauauugcaacuacucgaaguauugguacuugaaucacaccguuacuggcaaaacaucucucccccgcuguuggcugguguccaacgggucauacuuaaaugaaacccacuucagugacgauaucgagcagcaggccgacaacaugauuacggagcugcuacaaaaggaauauauagaucgacagggaaaaaccccucucggucuggucgaccuuuuuguguucagcacauccuuuuacuugaucucuauuuuccugcaccucgugaagaucccaacucauagacacgucaucggcaaacccugcccuaagccacauaggcugaaucacauggggauuuguagcugcggacuuuauaaacacccgggcguucccgugaaguggaagcgguga

SEQ ID NO: 1587 - RNA, 1473 nt, Artificial Sequence
  derived and/or modified CDS sequence (opt3) from Lassa virus__AIT17420__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaauaccgcgguggcaaaguguaacgaaaaacaugacgaggaguucugcgauauguugcggcuauuugacuucaauaagcaggccauucgcagacugaaaacugaagcucagauguccauccagcucauaaacaaggccguaaaugcacugauuaacgaucaacuuaucaugaagaaucaccugagggacaucaugggcauuccauauugcaacuacagcaaauauugguacuugaaucacacaguuaccggcaagacgucgcucccccgguguuggcuggugucuaacggguccuacuuaaaugaaacccauuucucagacgauaucgagcagcaggcugacaacaugauuacagagcugcuacaaaaagaauauauggaucgccagggaaagacuccucucggucuggucgaccuuuuuguguucaguaccagcuuuuacuugauauccaucuuccugcaccucauuaaaaucccaacacaucgacacaucacuggcaagcccugcccuaaaccacauagacugaaucacauggggauuuguucuugcggacuuuauaagcacccgggcgugcccgucaaguggaaaagguga

SEQ ID NO: 1588 - RNA, 1473 nt, Artificial Sequence
  derived and/or modified CDS sequence (opt3) from Lassa virus__AIT17424__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacaugacaaaccucaauaugacuaugccucugaguuguaccaagaacaauagccaucacuauaucauggugggaaacgaaacaggccuggagcucaccuuaacuaauacauccauaaucaaccauaaauucugcaaucugucugaugcccacaagaaaaaccuuuacaaucaugcguugaugucgauuaucucaaccuuucaccugagcauuccaaacuucaaucaguaugaggcuaugaguugugacuuuaacggugggaagaucuccguucaguacaaucuaucucacgccuaugcaguggaugccgcuaaccauugcggaacgauagcaaacggcguccuccaaacuuucaugaggauggccuggggcgggagcuacauugcucuggacuccggaaaggguucaugggauuguaucaugaccaguuaccaguaucuuauuauccagaauacaacuugggaagaccacugccaguuuagccggccgucucccaucggcuaccugggguugcucucccaacgcacccgagauauuuauauaucacguagacuguuaggaacauucaccuggacgcugagcgacagugagggcaacgaaacuccugguggguacugucucacaagguggaugcuuaucgaggccgagcugaaaugcuuuggaaauaccgcgguggcaaaguguaacgaaaaacaugaugaggaguucugcgacauguugcggcuauuugauuucaauaagcaggccauucgcagacugaaaacugaagcucagacaaacauccagcucauaaauaaggccguaaacgcacugauuaaugaccaacuuaucaugaagaaccaccugagggauaucaugggcauuccauauugcaauuacucuaaauauugguacuugaaccacaccguuacgggcaagaccucccucccccgguguuggcuggugagcaaugggucguacuuaaacgaaacacauuucucugacgacaucgagcagcaggcugauaauaugauuacugagcugcuacaaaaagaauauauggaccgccagggaaagaccccucucggucuggucgaucuuuuuguguucuccacaucauuuuacuugauaaguaucuuccugcaccucgugaaaauuccaacucaucgacacaucaucggcaagcccugcccuaaaccacauagacugaaccacauggggauuuguagcugcggacuuuauaagcacccgggcguccccguuaaguggaaaagguga

SEQ ID NO: 1589 - RNA, 1473 nt, Artificial Sequence
  derived and/or modified CDS sequence (opt3) from Lassa virus__AIT17428__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgccgcggaccugaaaugcuuuggaaauaccgcaguggccaaguguaacgagaaacaugaugaggaguucugcgacauguugcggcuauuugauuucaauaagcaggcuauugaacgccugaaaacugaagcccagauguccauccagcucauaaacaaggcaguaaaugcucugauuaacgaccaacuuaucaugaagaaucaccugagagacaucaugggcauuccauauugcaacuacagcaaauauugguacuugaaucacacaguuaccggcaggacgucgcucccccgguguuggcuggugucuaacggguccuacuuaaaugagacccauuucucagaugacaucgaacagcaggccgauaacaugauuacagagcugcuacaaaaggaguauauggaccgccagggaaaaacuccucucggucuggucgaucuuuuuguguucaguaccagcuuuuacuugauauccaucuuccugcaccucgugcgaaucccaacacauagacacgucauuggcaagcccugcccuaaaccacauaggcugaaucacauggggaucuguucuugcggacuuuauaagcacccgggcguucccgugaaauggaagcgguga

SEQ ID NO: 1590 - RNA, 1473 nt, Artificial Sequence
  derived and/or modified CDS sequence (opt3) from Lassa virus__AIT17430__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaggaucucuguucaguacaaucuaagccacaccuaugcaguggacgccgcuaagcauugcggaacgauagcaaacggcguccuccaaacuuucaugcggauggccuggggcggguccuacauugcucuggauucaggaaaggguaguugggacuguaucaugaccagcuaccaguaucuuauuauccagaauacaacuugggaagaucacugccaguuuucucgcccgucccccaucggcuaccugggguugcucucacaacgaacccgugacauuuauauaagcagaaggcuguuaggaacauucaccuggacgcugagugauucugagggcaacgaaacuccugguggguacugucucacacgguggaugcuuaucgaggccgagcugaaaugcuuuggaaacaccgcgguggcaaaguguaaugaaaaacaugacgaggaguucugcgauauguugcgccuauuugacuucaacaagcaggccauuagaaggcugaaaacugaagcucagauguccauccagcucauaaauaaggccguaaacgcacugauuaaugaucaacuuaucaugaagaaccaucugcgggacaucaugggcauuccauauugcaauuacagcaaauauugguacuugaaccacacaguuaccggcaagacgucgcucccccgcuguuggcuggugucuaauggguccuacuuaaacgaaacccacuucucagacgauaucgagcagcaggcugacaauaugauuacagagcugcuacaaaaagaauauauagaucgacagggaaagacuccucucggucuggucgaccuuuuuguguucaguaccagcuuuuacuugaucuccauuuuccugcaccucgugaaaaucccaacacauagacacgucaucggcaagcccugcccuaaaccacauaggcugaaccacauggggauuuguucuugcggacuuuauaagcacccgggcguucccgugaaguggaaacgguga

SEQ ID NO: 1591 - RNA, 1473 nt, Artificial Sequence
  derived and/or modified CDS sequence (opt3) from Lassa virus__AIT17438__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccaaccucaauaugacaaugccucugaguuguacuaagaacaauagccaucacuauaucagggugggaaacgaaaccggccuggagcucacauuaaccaauacuuccauaaucucucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugcggauggccuggggcggguccuacauugcucuggauucaggaaaggguaguugggacuguaucaugaccagcuaccaguaucuuauuauccagaacacaacuugggaagaucacugccaguuuucucgcccgucccccaucggcuaccugggguugcucucacaacgaacccgugacauuuauauaagcagaaggcuguuaggaacauucaccuggacgcugagugauucugagggcaaagaaacuccugguggguacugucucacacgguggaugcuuaucgaggccgagcugaagugcuuuggaaacaccgcgguggcaaaauguaaugaaaagcaugacgaggaguucugcgauauguugcgccuauuugacuucaacaaacaggccauuagaaggcugaagacugaagcucagaugaauauccagcucauaaacaaggccguaaaugcacugauuaacgaucaacuuaucaugaaaaaucaucugcgggacaucaugggcauuccauauugcaacuacuccaaguauugguacuugaaucacacaguuaccggcaaaacgagccucccccgcuguuggcuggugucgaacgggucuuacuuaaaugaaacccacuucuccgacgauaucgagcagcaggcugacaacaugauuacagagcugcuacaaaaggaauauauagaucgacagggaaaaacuccucucggucuggucgaccuuuuuguguucucaaccaguuuuuacuugaucagcauuuuccugcaccucgugaagaucccaacacauagacacgucaucggcaaacccugcccuaagccacauaggcugaaucagauggggauuuguuccugcggacuuuauaagcagccgggcguucccgugaaauggaagcgguga

SEQ ID NO: 1592 - RNA, 1473 nt, Artificial Sequence
  derived and/or modified CDS sequence (opt3) from Lassa virus__AIT17442__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaggaagaaucuuuacgaccaugcuuugaugucaauuaucagcacauuucaccugaguauuccaaacuucaaucaguaugaggccauguccugugauuuuaacggugggaaaaucucuguucaguacaaucuaagccacgcauaugccguggacgcugcaaaccauugcggaaccauagccaauggcguccuccaaacguucaugcggauggcuuggggcggguccuacauugcccuggauucaggaaaggguaguugggacuguaucaugacuagcuaccaguaucuuauuauccagaacaccucuugggaagaucacugccaguuuucccgcccgucacccaucggcuaccugggguugcucagccaacgaacacgugacauuuauauaaguagaaggcuguuaggaacuuucaccuggacacugucugauuccgagggcaacgaaaccccugguggguacugucucacgcgguggaugcuuaucgaggcggagcugaagugcuuuggaaauacugcaguggccaaauguaacgaaaagcaugacgaggaguucugcgauauguugcgccuauuugacuucaauaaacaggcuauuagaaggcugaagacagaagcccagaugagcauccagcucauaaacaaagcaguaaaugcucugauuaacgaucaacuuaucaugaagaaucaucugcgggacaucaugggcauuccauauugcaacuacucgaaguauugguacuugaaucacaccguuacuggcaaaacaucucucccccgcuguuggcugguguccaacgggucauacuuaaaugaaacccacuucagugacgauaucgagcagcaggccgacaacaugauuacggagcugcuacaaaaggaauauauagaucgacagggaaaaaccccucucggucuggucgaccuuuuuguguucagcacauccuuuuacuugaucucuauuuuccugcaccucgugaagaucccaacucauagacacgucaucggcaaacccugcccuaagccacauaggauuaaucacauggggauauguagcugcggacuguauaaacacccgggcguucccgugaaguggaagcgguga

SEQ ID NO: 1593 - RNA, 1473 nt, Artificial Sequence
  derived and/or modified CDS sequence (opt3) from Lassa virus__AIT17446__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuucccauugcggaacggucgcaaacggcgugcuccaaacuuucaugaggauggccuggggcgggucauacauagcucuggauaguggaaaggguagcugggacuguauuaugaccucuuaccaguaucuuaucauucagaauacaacuugggaagaucacugccaguuuucccggccgucacccaucggcuaccugggguugcucagccaacgcacccgagacaucuauauuagucguagacuguuaggaacauucaccuggacgcugucugauuccgagggcaacgaaacuccugguggguacugucucacaagguggaugcuuauagaggccgagcugaaaugcuuuggaaacaccgcgguagcaaaguguaaugaaaaacaugacgaggaguucugcgauauguugcggcuauuugacuucaacaagcaggccauccgcagacugaaaacugaagcucagaugagcauucagcucaucaauaaggccguuaacgcacugauaaaugaucaacuuauuaugaagaaccaccugagggacaucaugggcaucccauauugcaauuacucgaaauauugguacuugaaccacacagugaccggcaagacgucucucccccgguguuggcuggucuccaaugggucauacuuaaacgaaacccauuucagugacgauauugagcagcaggcugacaauaugaucacagagcugcuacaaaaagaauauauggaucgccagggaaagacuccucucggucugguggaccuuuuuguguucagcaccuccuuuuacuugauuucuauauuccugcaccucgucaaaaucccaacacaucgacacguuauuggcaagcccugcccuaaaccacauagacugaaccacauggggaucuguagcugcggacuuuauaagcacccgggcgugcccguaaaguggaaaagguga

SEQ ID NO: 1594 - RNA, 1473 nt, Artificial Sequence
  derived and/or modified CDS sequence (opt3) from Lassa virus__AIT17450__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaauaccgcgguggcaaaguguaacgaaaaacaugacgaggaguucugcgauauguugcggcuauuugacuucaauaagcaggccauucgcagacugaaaacugaagcucagauguccauccagcucauaaacaaggccguaaaugcacugauuaacgaucaacuuaucaugaagaaucaccugagggacaucaugggcauuccauauugcaacuacagcaaauauugguacuugaaucacacaguuaccggcaagacgucgcucccccgguguuggcuggugucuaacggguccuacuuaaaugaaacccauuucucagacgauaucgagcagcaggcugacaacaugauuacagagcugcuacaaaaagaauauauagaucgccagggaaagacuccucucggucuggucgaccuuuuuguguucaguaccagcuuuuacuugaucuccauuuuccugcaccucgugaaaaucccaacacaucgacacaucauuggcaagcccugcccuaaaccacauagacugaaucacauggggauauguucuugcggacuuuauaagcacccgggcguccccguuaaguggaaaagguga

SEQ ID NO: 1595 - RNA, 1473 nt, Artificial Sequence
  derived and/or modified CDS sequence (opt3) from Lassa virus__AIT17454__GPC
augggccagaucauuaccuucuuucaagaggugccccacgucauagaagagguuaugaacaucgugcugauugccuucagccuccuugcuauccugaaggggauuuacaauguagcaacaugcggauuguuugguuuaguguccuuccugcuacucuguggcagaucuugcucaacuacguauaaaggggucuacgaacugcagacccuugagcuggacauggccaguuugaacaugacaaugccucucagcuguacuaagaauaacucccaucacuauaucauggugggaaaugaaaccggccuggagcugacacucaccaacacuucuauaaucaaucauaaauuuugcaacuuaucggaugcgcacaagaggaaucuguacgaccaugcucuuaugucaauuaucagcacauuccacuugaguauuccaaacuuuaaucaguaugaggccauguccugugauuucaacggugggaaaaucucuguucaguacaaucugagccacaccuaugcaguggacgccgcuggacauugcggcacgauagcaaacggcguccuacaaacuuuuaugcggauggccuggggaggguccuacauugcucucgauucagguaagggcaguugggacuguaucaugaccagcuaccaguaucugauuauccagaauacaacuugggaagaucacugccaguucucucgcccgucccccaucggguaccuuggacuguugucacaacgaacccgugacauuuauauaagcagaaggcuccugggcacauuuaccuggacguuaagugauucugaggguaacgaaacuccugggggauacugucugacacgguggaugcucaucgaggccgagcuuaagugcuucggcaacaccgcgguggcaaaauguaaugaaaagcaugacgaggaauuuugcgauaugcugcgcuuguucgacuucaacaaacaggccauuagaaggcuaaagacugaggcucagauguccauccagcugauaaauaaagccguaaacgcacucauuaaugaucaacugaucaugaagaaccaccuucgggacaucaugggcauuccauauugcaauuacagcaaguauugguaccugaaccacacaaucaccgggaaaacgucguugccccgcuguuggcucguuucuaauggauccuaccugaacgaaacccauuuuucagacgauauugagcagcaggcugacaauaugauaacagaguuacugcaaaaggaauauauggaucgacaggguaaaacuccucuaggccucguggaccuguucgucuuuaguaccagcuucuaccuuaucuccaucuuuuugcaccuggugaagauuccaacacauagacacaucauugggaaacccugcccuaagccacauaggcucaaccacaugggaauauguucuugcggccuguauaaacacccgggugugcccguccgguggaagcguuga

SEQ ID NO: 1596 - RNA, 1473 nt, Artificial Sequence
  derived and/or modified CDS sequence (opt3) from Lassa virus__AIT17458__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaauagacgccgcuaaccauugcggaacgauugcaaauggcgugcuccaaacuuucaugaggauggccuggggcggguccuacaucgcucuggauucaggaaaggguaguugggacuguauuaugaccacauaccaguaucuuaucauccagaacacuaccugggaagaucacugccaguuuagccggccgucucccauuggcuaccugggguugcucucccaacgcacacgagacauauauaucucacguagacuguuaggaaccuucacguggacucugagcgauagugagggcaacgaaacaccugguggguacugucucaccagguggaugcuuauugaggccgagcugaaaugcuuuggaaauacugcggucgcaaaguguaacgaaaaacaugacgaggaguucugcgauauguugcggcuauuugacuucaauaagcaggccauccgcagacugaaaacagaagcucagaugucuauacagcucauuaacaaggccgugaaugcacugaucaacgaucaacuuaucaugaagaaucaccugagggacauuaugggcaucccauauugcaacuacuccaaauauugguacuugaaucacaccguaacgggcaagaccagccucccccgguguuggcugguuucgaacgggucuuacuuaaaugaaacacauuucuccgacgauauugagcagcaggcugacaacaugauaacugagcugcuacaaaaagaauauauggaucgccagggaaagaccccucucggucugguggaccuuuuugucuucucaacaaguuuuuacuugaucagcauuuuccugcaccucgugaaaaucccaacucaucgacacgugaucggcaagcccugcccuaaaccacauagacugaaucacauggggauuuguuccugcggacuuuauaagcacccgggcguccccguuaaguggaaaagguga

SEQ ID NO: 1597 - RNA, 1473 nt, Artificial Sequence
  derived and/or modified CDS sequence (opt3) from Lassa virus__AIT17462__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaguugggacuguaucaugacuagcuaccaguaucuuauuauccagaacaccacaugggaagaucacugccaguuuucucggccgucccccaucggcuaccugggguugcucucacaacgcacucgagacauuuauauaagccguagacuguuaggaaccuucacauggacccugagugauucugagggcaacgaaacgccugguggguacugucucacuagguggaugcuuaucgaggcggagcugaaaugcuuuggaaauacagcaguggccaaguguaacgaaaaacaugacgaggaguucugcgauauguugcggcuauuugacuucaauaagcaggcuauucgcagacugaaaaccgaagcccagauguccauccagcucauaaacaaggcaguaaaugcucugauuaacgaucaacuuaucaugaagaaucaccugagggacaucaugggcauuccauauugcaacuacagcaaauauugguacuugaaucacacuguuacaggcaagaccucgcuccccaaauguuggcuggugucuaacggguccuacuuaaaugaaacgcauuucucagacgauaucgagcagcaggccgacaacaugauuaccgagcugcuacaaaaggaauauauagaucggcagggaaaaacaccucucggucuggucgaccuuuuuguguucaguacuagcuuuuacuugaucuccauuuuccugcaccucgugaagaucccaacccaucgccacgucaucggcaaacccugcccuaagccacaucgacugaaucacauggggauuuguucuugcggacuuuauaagcacccgggcguucccgugaaauggaagagauga

SEQ ID NO: 1598 - RNA, 1473 nt, Artificial Sequence
  derived and/or modified CDS sequence (opt3) from Lassa virus__AIT17466__GPC
augggccagaucauuaccuucuuucaagaggugccccaggucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaccauuauaucauggugggaaaugaaaccggccuggagcucacauuaaccaaccagucuauaaucaaucacaaauucugcaaccugucggaugcgcauaagaaaaaucuuuacgaccacgcuuugaugucaauuaucagcacuuuucaucugaguauuccaaacuucaaucaauaugaggccauguccugugauuuuaacggugggaagaucucuguucaguacaaucuaagccacacauucgcaguggacgccgcuaaccacugcggaaccauagcaaauggcguccuccagacguuuaugaggauggccuggggcggguccuauauugcucuggauucaggacgggguaguugggacuguaucaugacuagcuaccaguaccuuauuauccaaaacaccacaugggaagaucauugccaguucucucgcccgucccccaucggcuaucugggguugcucucacagcgaacucgugacauuuacauaagcagaaggcuguuaggaaccuuuacauggacccugagugauucugagggcaacgaaacgccugguggguauugucucacucgguggaugcuuaucgaggccgagcugaagugcuucggaaauacagcgguggcaaaauguaacgaaaagcacgacgaggaauuuugcgauauguugcgccuauucgacuucaauaaacaggccauuagaaggcugaagaccgaggcucaaauguccauccagcucauaaacaaagccguaaaugcacugauuaacgaucagcuuaucaugaagaaucaucugcgggacaucaugggcauuccauacugcaacuauagcaaguacugguauuugaaucacacuaucacaggcaaaaccucgcucccccgcuguuggcugguuucuaacggguccuacuuaaaugaaacgcacuuuucagacgauauugagcaacaggcugacaacaugauaaccgagcugcuacagaaggaauacauggaucgacagggaaaaacaccucucggucugguggaccuuuucgucuuuaguacuagcuucuauuugaucuccauuuuucugcaucucgugaagaucccaacccacagacaugugaucggcaaacccugcccuaagccacacaggcugaaucauauggggauuuguucuugcggacuuuacaaacacccgggcguccccguuaaguggaagcgguga

SEQ ID NO: 1599 - RNA, 1473 nt, Artificial Sequence
  derived and/or modified CDS sequence (opt3) from Lassa virus__AIT17470__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaggaagaaucuuuacgaccaugcuuugaugucaauuaucagcacauuucaccugaguauuccaaacuucaaucaguaugaggccauguccugugauuuuaacggugggaaaaucucuguucaguacaaucuaagccacaccuaugcaguggacgccgcuaaccauugcggaacgauagcaaauggcguccuccaaacuuucaugcggauggccuggggcggguccuacauugcucuggauucaggaaaggguaguugggacuguaucaugaccagcuaccaguaucuuauuauccagaacacaacuugggaagaucacugccaguuuucucgcccgucccccaucggcuaccugggguugcucucacaacgaacccgugacauuuauauaagcagaaggcuguuaggaacauucaccuggacgcugagugauucugagggcaacgaaacuccugguggguacugucucacacgguggaugcuuaucgaggccgagcugaagugcuuuggaaauaccgcgguggcaaaauguaacgaaaagcaugacgaggaguucugcgauauguugcgccuauuugacuucaauaaacaggccauuagaaggcugaagacugaagcucagauguccauccagcucauaaacaaagccguaaaugcacugauuaacgaucaacuuaucaugaagaaucaucugcgggacaucaugggcauuccauauugcaacuacagcaaguauugguacuugaaucacacaguuaccggcaaaacgucgcucccccgcuguuggcuggugucuaacggguccuacuuaaaugaaacccacuucucagacgauaucgagcagcaggcugacaacaugauuacagagcugcuacaaaaggaauauauagaucgacagggaaaaacuccucucggucuggucgaccuuuuuguguucaguaccagcuuuuacuugaucuccauuuuccugcaccucgugaagaucccaacacauagacacgucaucggcaaacccugcccuaagccacauaggcugaaucacauggggauuuguucuugcggacuuuauaaacacccgggcguucccgugaaguggaagcgguga

SEQ ID NO: 1600 - RNA, 1473 nt, Artificial Sequence
  derived and/or modified CDS sequence (opt3) from Lassa virus__AIT17474__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuauacaguacaaucuaagccacaccuaugcaguugacgccgcuaaccauugcggaacgauugcaaauggcgugcuccaaacuuucaugaggauggccuggggcggguccuacaucgcucuggauucaggaaaggguaguugggacuguauuaugaccagcuaccaguaucuuaucauccagaacacaacuugggaagaucacugccaguuuucucggccgucccccauuggcuaccugggguugcucucacaacgcacccgagacauauauaucagccguagacuguuaggaacauucaccuggacgcugagugauucugagggcaacgaaacuccugguggguacugucucacaagguggaugcuuauugaggccgagcugaaaugcuuuggaaauaccgcggucgcaaaguguaacgaaaaacaugacgaggaguucugcgauauguugcggcuauuugacuucaauaagcaggccauccgcagacugaaaacugaagcucagauguccauacagcucauuaacaaggccgugaaugcacugaucaacgaucaacuuaucaugaagaaucaccugagggacauuaugggcaucccauauugcaacuacagcaaauauugguacuugaaucacacaauuaccggcaagacgucgcucccccgguguuggcugguaucuaacggguccuacuuaaaugaaacccauuucucagacgauauagagcagcaggcugacaacaugaucacagagcugcuacaaaaagaauauauugaucgccagggaaagacuccucucggucugguugaccuuuuuguguucaguaccagcuuuuacuugaucuccaucuuccugcaccucgucaaaauuccaacacaucgacacauaacuggcaagcccugcccuaaaccacauagacugaaucacauggggaucuguucuugcggacuuuauaagcacccgggcgugcccgugagguggaagcgguga

SEQ ID NO: 1601 - RNA, 1473 nt, Artificial Sequence
  derived and/or modified CDS sequence (opt3) from Lassa virus__AIT17478__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcugaucauugcggaacgauagcaaacggcguccuccaaacuuucaugaggauggccuggggcggguccuacauugcucuggacucaggaaaggguaguugggauuguaucaugaccagcuaccaguaucuuauuauccagaauacaacuugggaagaccacugccaguuuucucggccgucccccaucggcuaccugggguugcucucacaacgcacccgagauauuuauauaagccguagacuguuaggaacauucaccuggacgcugagugacucugagggcaacgaaacuccugguggguacugucucacaagguggaugcuuaucgaggccgagcugaaaugcuuuggaaacaccgcgguggcaaaguguaaugaaaaacaugaugaggaguucugcgacauguugcggcuauuugauuucaacaagcaggccauuucccgccugaaaacugaagcucagaugagcauccagcucauaaauaaggccguaaacgcacugauuaaugaccaacuuaucaugaagaaccaccugagagacaucaugggcauuccauauugcaauuacucgaaauauugguacuugaaccacacaguuaccggcaagacgucucuccccagguguuggcugguguccaaugggucauacuuaaacgaaacccauuucagugaugacaucgagcagcaggcugauaauaugauuacagagaugcugcaaaaagaauauauagaccggcagggaaagacuccucuaggucucgucgaucuguuuguguucagcaccuccuuuuaccuuaucucuauuuucuugcaccuggugaaaaucccaacacaucgccacgucaucggcaagcccugcccuaaaccacaucgacucaaccacauggggauuuguagcugcggacuguauaagcacccgggcguucccgugaaguggaaaagauga

SEQ ID NO: 1602 - RNA, 1473 nt, Artificial Sequence
  derived and/or modified CDS sequence (opt3) from Lassa virus__AIT17482__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaguugggacuguaucaugacuagcuaccaguaucuuauuauccagaacaucaccugggaagaucacugccaguuuucucggccgucccccauuggcuaccugggguugcucucacaacgcacacgagacauauauaucagccguagacuguuaggaacuuucaccuggacacugagugauucugagggcaacgaaaccccugguggguacugucucacgagguggaugcuuauugaggcggagcugaaaugcuuuggaaauacugcaguggccaaguguaacgaaaaacaugacgaggaguucugcgauauguugcggcuauuugacuucaauaagcaggcuauccgcagacugaaaacagaagcccagauguccauacagcucauuaacaaggcaguaaaugcucugaucaacgaucaacuuaucaugaagaaucaccugagggacauuaugggcaucccauauugcaacuacagcaaauauugguacuugaaucacaccguuacuggcaagacaucgcucccccgguguuggcuggugucuaacggguccuacuuaaaugaaacccauuucucagacgauauugagcagcaggccgacaacaugauaacggagcugcuacaaaaagaauauaucgaucgccagggaaagaccccucucggucuggucgaccuuuuuguguucaguacuagcuuuuacuugauuuccaucuuccugcaccucgugaaaaucccaacacaucgacacgucguuggcaagcccugcccuaaaccacauagacugaaucacauggggauuuguucuugcggacuuuauaagcacccgggcgugcccguaaaguggaaaagguga

SEQ ID NO: 1603 - RNA, 1473 nt, Artificial Sequence
  derived and/or modified CDS sequence (opt3) from Lassa virus__AIT17486__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccgugggcuaccugggguugcucucacaacgcacccgagacaucuauauuagccguagacuguuaggaacauucaccuggacgcugagugauucugagggcaacgaaacuccugguggguacugucucacaagguggaugcuuauagaggccgagcugaaaugcuuuggaaauaccgcgguagcaaaguguaacgaaaaacaugacgaggaguucugcgauauguugcggcuauuugacuucaauaagcaggccauccgcagacugaaaacugaagcucagauguccauucagcucaucaacaaggccguuaaugcacugauaaacgaucaacuuauuaugaagaaucaccugagggacaucaugggcaucccauauugcaacuacagcaaauauugguacuugaaucacacagugaccggcaagacgucgcucccccgguguuggcuggucucuaacggguccuacuuaaaugaaacccauuucucagacgauauugagcagcaggcugacaacaugaucacagagcugcuacaaaaagaauauauugaucgccagggaaagacuccucucggucugguggaccuuuuuguguucaguaccagcuuuuacuugauauccaucuuccugcaccucgucaaaauuccaacacaucgacacguuaucggcaagcccugcccuaaaccacauagacugaaucacauggggaucuguucuugcggacuuuauaagcacccgggcgugcccguaaaguggaaaagguga

SEQ ID NO: 1604 - RNA, 1473 nt, Artificial Sequence
  derived and/or modified CDS sequence (opt3) from Lassa virus__AIT17490__GPC
augggccagaucauuaccuucuuucaagaggugccccacgucauagaagagguuaugaacaucgugcugauuacacucagccuucuggccaucuugaaggggauuuacaauguagcuacuugcggauuauucggucugguguccuuucuacuccuguguggcagaucuugcucaacgaccuauaaaggggucuacgaacuucagacacuggaguuggacauggcaaaccucaauaugacuaugccucugaguuguaccaagaacaauagccaucacuauaucauggugggaaacgaaacaggccuggagcucaccuuaacuaauacauccauaaucaaccauaaauucugcaaucugucugaugcccacaagaaaaaccuuuacgaccaugcguugaugucgauuaucucaaccuuucaccugagcauuccaaauuucaaccaguaugaggcuaugaguugugauuuuaauggugggaagaucuccguucaguacaaccuaucucacacguucgccguggacgcagccaaucauugcggaacuauagcuaacggcguccuccaaaccuuuaugaggauggcauggggcgggagcuauauugcccuggauuccggaaaggguucaugggacuguaucaugacaaguuaccaguaccuuauuauccagaacacuaccugggaagaucacugccaguucagccggccgucucccaucggcuaucugggguugcucucccaacgcacacgagacauuuacauaucacguagacuguuaggaaccuuuacguggacucugagcgauagugagggcaaugaaacaccugguggguauugucucaccagguggaugcuuaucgaggcugagcugaaaugcuucggaaacacugccguggcgaaguguaaugaaaaacaugacgaggaauuuugcgauauguugcggcuauucgacuucaacaagcaggcaauucgcagacugaaaacagaggcccagaugucuauccagcucauaaauaaggcuguaaacgcccugauuaaugaucaacuuaucaugaagaaccaccugagggacaucaugggcauuccauacugcaauuauuccaaauacugguauuugaaccacaccguuacgggcaagaccagccucccccgguguuggcuggugucgaaugggucuuacuuaaacgaaacacauuuuuccgacgauaucgagcagcaggcagacaauaugauuacugagcugcuacaaaaagaauacauggaucgccagggaaagaccccucucggucuggucgaccuuuucguguuuucaacaaguuucuauuugauaagcaucuuucugcaccucgugaaaauuccaacucaucgacacaucaucggcaagcccugcccuaaaccacauagacugaaccacauggggauuuguuccugcggacuuuacaagcacccgggcguccccguuaaguggaaaagguga

SEQ ID NO: 1605 - RNA, 1473 nt, Artificial Sequence
  derived and/or modified CDS sequence (opt3) from Lassa virus__AIT17494__GPC
augggccagaucauuaccuucuuucaagaggugccccacgucauagaagagguuaugaacaucgugcugauugcccucagccuucuggcuaucuugaaggggguauacaauguggcaacaugcggauuauucggucuggucuccuuucuacuccuguguggcagaucuugcucaacuauuuauaaagggguguacgaacuucagacgcuggaguuggacauggccagucucaacaugaccaugccucugagcuguacaaagaauaacucccaucacuauaucaugguuggaaaugaaacuggccuggagcucaccuuaacaaacaccucuauaaucaaucauaaauucugcaaccugucggaugcgcacaagaaaaaucuuuacgaccaugcuuugaugucaauuaucagcacuuuucaccugaguauuccaaacuucaaucaguaugaggccauguccugugauuuuaacggugggaagaucucugugcaguacaaucuaagccacacauaugcagucgacgccgcuaaccauugcggaaccauagcaaauggcgugcuccaaacguucaugaggauggccuggggcggguccuacauugcucuggauucaggaaaggguaguugggacuguaucaugacuagcuaccaguaucuuauuauccagaacaccucuugggaagaucacugccaguuuucccggccgucacccaucggcuaccugggguugcucagccaacgcacacgagacauuuauauaagucguagacuguuaggaacuuucaccuggacacugucugauuccgagggcaacgaaaccccugguggguacugucucacgagguggaugcuuaucgaggccgagcugaaaugcuuuggaaauacugcgguagcaaaguguaacgaaaaacaugacgaggaguucugcgauauguugcggcuauuugacuucaauaagcaggccauucgcagacugaaaacagaagcucagaugagcauccagcucauaaacaaggccguuaaugcacugauuaacgaucaacuuaucaugaagaaucaccugagggacaucaugggcauuccauauugcaacuacucgaaauauugguacuugaaucacaccgugacuggcaagacaucucucccccgguguuggcuggucuccaacgggucauacuuaaaugaaacccauuucagugacgauaucgagcagcaggcugacaacaugauuacggagcugcuacaaaaagaauauauagaucgccagggaaagaccccucucggucugguggaccuuuuuguguucagcacauccuuuuacuugaucucuauuuuccugcaccucgucaaaaucccaacucaucgacacguuaucggcaagcccugcccuaaaccacauagacugaaucacauggggauuuguagcugcggacuuuauaagcacccgggcgugcccguaaaguggaaaagguga

SEQ ID NO: 1606 - RNA, 1473 nt, Artificial Sequence
  derived and/or modified CDS sequence (opt3) from Lassa virus__AIT17498__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaacugggacuguaucaugaccaguuaccaguaucuuauuauccagaacacaacuugggaagaucacugccaguuuagccggccgucucccaucggcuaccugggguugcucucccaacgcacccgagacauuuauauaucacguagacuguuaggaacauucaccuggacgcugagcgauagugagggcaaugaaacuccugguggguacugucucacaagguggaugcuuaucgagaccgagcugaaaugcuuuggaaacacugccguggcgaaguguaaugaaaaacaugacgaggaguucugcgauauguugcggcuauuugacuucaacaagcaggcaauuucucgccugagauccgaagcccagaugagcauccagcucauaaauaaagcuguaaacgcccugauuaaugaucaacuuaucaugaagaaccaccugagggacaucaugggcauuccauauugcaauuacucgaaguauugguacuugaaccacacaguuaccggcaaaacgucucuccccaaguguuggcugguguccaaugggucauacuuaaacgaaacccauuucagugacgauaucgagcagcaggcagacaauaugauuacagagaugcugcaaaaagaauauauagaucggcagggaaagacuccucuaggucucgucgaccuguuuguguucagcaccuccuuuuaccuuaucucuauuuucuugcaccuggugaaaaucccaacacaucgccacaucacuggcaagcccugcccuaaaccacaucgacucaaccacauggggauuuguagcugcggacuguauaagcacccgggcguccccguuaaguggaaaagauga

SEQ ID NO: 1607 - RNA, 1473 nt, Artificial Sequence
  derived and/or modified CDS sequence (opt3) from Lassa virus__AIT17502__GPC
augggccagaucauuaccuucuuucaagagauaccccacgugaucgaagaggucaugaacauuguucugaucacacucagccuucuggccauuuugaaggggaucuacaauguggcuacuugcggauuauucggucugguauccuuucuacuccuguguggcaaaucuugcucaacgaccuauaaggggguguacgaacuucagacacuggaguuggacauggcaagucucaacaugacuaugccucugagcuguaccaaaaauaacucccaucacuauauaauggucggaaaugaaacaggccuggagcucaccuuaacuaacacaucuaucauuaaucauaaguucugcaaccugucggaugcccaccggaaaaaucuuuacgaccauaccuugaugucaaucauuagcacguuucaccugaguaucccaaacuucaaucaguaugaggcgauguccugugauuuuaacggugggaagauaucugugcaguacaaucuaagccacgcuuaugccauugacgcagccacucauugcggaaccaucgcuaacggcguucuccaaacauucaugaggauggcauggggcggguccuacauugcccuggauucaggaaaggguggcugggacuguaucaugaccaguuaccaguaucuuaucauucagaauacuacaugggaagaucacugccaguuuagccggccgucucccauaggguaccugggauugcucucccaacgcacccgagacaucuauauuucacguagacuguuaggcacguucacuuggacacugagcgauagugaggguaacgaaaccccugggggauacugucucacuagguggaugcuuaucgaggcugagcugaaaugcuuuggcaacacagccguggcgaaguguaaugaaaaacaugacgaggaguucugcgauauguugcggcuauuugacuucaacaagcaggcaauacgcagacugaaaaccgaagcccagaugucuauucagcucaucaauaaggcugucaacgcccugaucaaugaucaacuuauuaugaggaaccaccugagagacaucaugggcauuccauauugcaauuacuccaaguauugguacuugaaccacacggugaccgggaaaacaagccuccccaaguguuggcugguaucgaauggaucuuacuuaaacgaaacucauuucuccgacgauauagagcagcaggcagacaauaugaucaccgagcugcuacaaaaagaauauauggaucgccaggguaagacaccucucggccugguugaccuuuuuguguucucaaccaguuuuuacuugauuagcaucuuccugcaccucgucaaaaucccaacucaucgacacgugauugggaagcccugcccuaaaccacauagacugaaccacaugggaguguguuccugcggccuuuauaagcacccggguguccccguuaaguggaaaagguga

SEQ ID NO: 1608 - RNA, 1473 nt, Artificial Sequence
  derived and/or modified CDS sequence (opt3) from Lassa virus__AIT17506__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcagaacauugcggaaccauagccaacggcguccuccaaacguucaugaggauggcuuggggcggguccuacauugcccuggauucaggaaaggguaguugggacugugugaugacuagcuaccaguaucuuaucauucagaauaccacaugggaggaucacugccaguuuucucggccgucccccaucggcuaccugggguugcucucacaacgcacucgagacaucuauauuagccguagacuguuaggaaccuucacauggacccugagugauucugaaggcaacgagacgccugguggguacugucucacuagguggaugcuuauagaggcggaacugaaaugcuuuggaaacacagcaguagccaaguguaaugagaaacaugacgaagaguucugcgauauguugcggcuauuugacuucaacaagcaggcuaucgaacgccugaaaaccgaggcccagauguccauucagcucaucaauaaggcaguuaacgcucugauaaaugaucaacuuauuaugaagaaccaccugagagacaucaugggcaucccauauugcaauuacagcaaauauugguacuugaaccacacugugacaggcaagaccucgcuccccagguguuggcuggucucuaauggguccuacuuaaacgagacgcauuucucagacgauauugaacagcaggccgacaauaugaucaccgagaugcugcaaaaagaauauauugaucggcagggaaagacaccucuaggucucguggaccuguuuguguucaguacuagcuuuuaccuuauauccaucuucuugcaccuggucaaaauuccaacccaucgccacguuaucggcaagcccugcccuaaaccacaucgacucaaccacauggggaucuguucuugcggacuguauaagcacccgggcgugcccguaaaguggaaaagauga

SEQ ID NO: 1609 - RNA, 1473 nt, Artificial Sequence
  derived and/or modified CDS sequence (opt3) from Lassa virus__AIT17510__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcaccaaagacauuuauauaagccgacgucuguuaggaacauucaccuggacgcugagugauucugagggcaacgaaacuccugguggguacugucucacaagauggaugcuuaucgaggccgagcugaagugcuuuggaaauaccgcgguggcaaaauguaacgaaaagcaugacgaggaguucugcgauauguugaggcuauuugacuucaauaaacaggccauucggcgccugaagacugaagcucagauguccauccagcucauaaacaaggccguaaaugcacugauuaacgaucaacuuaucaugaaaaaucaccugagagacaucaugggcauuccauauugcaacuacagcaaguauugguacuugaaucacacaguuaccggcaaaacgucgcuccccagguguuggcuggugucuaacggguccuacuuaaaugaaacccauuucucagacgauaucgagcagcaggcugacaacaugauuacagagcugcuacaaaaggaauauauagaucggcagggaaaaacuccucucggucuggucgaccuuuuuguguucaguaccagcuuuuacuugaucuccauuuuccugcaccucgugaagaucccaacacaucgccacgucaucggcaaacccugcccuaagccacaucgacugaaucacauggggauuuguucuugcggacuuuauaagcacccgggcguucccgugaaauggaagagauga

SEQ ID NO: 1610 - RNA, 1473 nt, Artificial Sequence
  derived and/or modified CDS sequence (opt3) from Lassa virus__AIT17514__GPC
augggccagaucauuaccuucuuucaagaggugccccacgucauagaagagguuaugaacaucgugcugauugcccucagccuucuggcuguauugaaggggaucuacaauguggcaacaugcggauuauucggucuggucuccuuucuacuccuguguggcagaucuugcucaacuacguauaaagggguguacgaacuucagacccuggaguuggacauggccagucucaacaugacaaugccucugagcuguacuaagaauaacucccaucacuauauuaugguuggaaaugaaaccggccuggagcucacauuaaccaacacuucuaucauaaaucauaaauucugcaaccugucggaugcgcacaagaaaaaucuuuacgaccaugcuuugaugucaaucauuagcacauuucaccugaguaucccaaacuucaaucaguaugaggccauguccugugauuuuaacggugggaagauuucugugcaguacaaucuaagccacaccuaugcagucgacgccgcuaaccauugcggaacgaucgcaaauggcgugcuccaaacuuucaugaggauggccuggggcggguccuacauagcucuggauucaggaaaggguaguugggacuguauuaugaccagcuaccaguaucuuaucauucagaacacaacuugggaagaucacugccaguuuucucggccgucccccaucggcuaccugggguugcucucacaacgcacccgagacaucuauauuagccguagacuguuaggaacauucaccuggacgcugagugauucugagggcaacgaaacuccugguggguacugucucacaagguggaugcuuauagaggccgagcugaaaugcuuuggaaauaccgcgguagcaaaguguaacgaaaaacaugacgaggaguucugcgauauguugcggcuauuugacuucaauaagcaggccauccgcagacugaaaacugaagcucagauguccauucagcucaucaacaaggccguuaaugcacugauaaacgaucaacuuauuaugaagaaucaccugagggacaucaugggcaucccauauugcaacuacagcaaauauugguacuugaaucacacagugaccggcaagacgucgcucccccgguguuggcuggucucuaacggguccuacuuaaaugaaacccauuucucagacgauauugagcagcaggcugacaacaugaucacagagcugcuacaaaaagaauauauugaucgccagggaaagacuccucucggucugguggaccuuuuuguguucaguaccagcuuuuacuugauauccaucuuccugcaccucgucaaaauuccaacacaucgacacguuaucggcaagcccugcccuaaaccacauagacugaaucacauggggaucuguucuugcggacuuuauaggcacccgggcgugcccguaaaguggaagcgguga

SEQ ID NO: 1611 - RNA, 1473 nt, Artificial Sequence
  derived and/or modified CDS sequence (opt3) from Lassa virus__AIT17518__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaguugggacuguaucaugacuagcuaccaguaucuuauuauccagaacaccacaugggaagaucacugccaguuuucucggccgucccccaucggcuaccugggguugcucucacaacgcacucgagacauuuauauaagccguagacuguuaggaaccuucacauggacccugagugauucugagggcaacgaaacgccugguggguacugucucacuagguggaugcuuaucgaggcggagcugaaaugcuuuggaaauacagcaguggccaaguguaacgaaaaacaugacgaggaguucugcgauauguugcggcuauuugacuucaauaagcaggcuauucgcagacugaaaaccgaagcccagauguccauccagcucauaaacaaggcaguaaaugcucugauuaacgaucaacuuaucaugaagaaucaccugagggacaucaugggcauuccauauugcaacuacagcaaauauugguacuugaaucacacuguuacaggcaagaccucgcucccccgguguuggcuggugucuaacggguccuacuuaaaugaaacgcauuucucagacgauaucgagcagcaggccgacaacaugauuaccgagcugcuacaaaaagaauauauggaucgccagggaaagacaccucucggucuggucgaccuuuuuguguucaguacuagcuuuuacuugauauccaucuuccugcaccucgugaaaauuccaacccaucgacacgucaucggcaagcccugcccuaaaccacauagacugaaucacauggggaucuguucuugcggacuuuauaagcacccgggcguucccgugaaguggaaaagguga

SEQ ID NO: 1612 - RNA, 1473 nt, Artificial Sequence
  derived and/or modified CDS sequence (opt3) from Lassa virus__AIT17524__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaauagacgccgcuaaccauugcggaacgauugcaaauggcgugcuccaaacuuucaugaggauggccuggggcggguccuacaucgcucuggauucaggaaaggguaguugggacuguauuaugaccagcuaccaguaucuuaucauccagaacacaacuugggaagaucacugccaguuuucucggccgucccccauuggcuaccugggguugcucucacaacgcacccgagacauauauaucagccguagacuguuaggaacauucaccuggacgcugagugauucugagggcaacgaaacuccugguggguacugucucacaagguggaugcuuauugaggccgagcugaaaugcuuuggaaauaccgcggucgcaaaguguaacgaaaaacaugacgaggaguucugcgauauguugcggcuauuugacuucaauaagcaggccauccgcagacugaaaacugaagcucagauguccauacagcucauuaacaaggccgugaaugcacugaucaacgaucaacuuaucaugaagaaucaccugagggacauuaugggcaucccauauugcaacuacagcaaauauugguacuugaaucacacaguaaccggcaagacgucgcucccccgguguuggcugguuucuaacggguccuacuuaaaugaaacccauuucucagacgauauugagcagcaggcugacaacaugauaacagagaugcugcaaaaagaauauauggaucgccagggaaagacuccucuaggucucguggaccuguuugucuucaguaccagcuuuuaccuuaucuccauuuucuugcaccuggugaaaaucccaacacaucgacacgugaucggcaagcccugcccuaaaccacauagacucaaucacauggggauuuguucuugcggacuguauaagcacccgggcguccccguuaaguggaaaagguga

SEQ ID NO: 1613 - RNA, 1473 nt, Artificial Sequence
  derived and/or modified CDS sequence (opt3) from Lassa virus__AIT17528__GPC
augggccagaucauuaccuucuuucaagaggugccccacgucauagaagagguuaugaacaucgugcugauugcccucagccuucuggcuauguugaaggggaucuacaauauugcaacaugcggauuauucggucugaucuccuuucuacuccuguguggcagaucuugcucaacuacguauaaagggguauacgaacuucaggcccuggaguuggacauggcgaaccucaauaugaccaugccucugaguuguacaaagaacaauagccaucacuauauaauggugggaaacgaaacuggccuggagcucaccuuaacaaauaccuccaucauuaaccauaaauucugcaaucugucugaugcucacaagaaaaaccuuuacgaccaugccuugaugucgaucauuucaacuuuucaccugagcaucccaaauuucaaccaguaugaggcaaugaguugugauuuuaauggugggaagauauccguccaguacaaccuaucucacacauaugccggagacgcugcaaagcauugcggcaccauugccaauggcgugcuccaaacguucaugaggauggcuuggggagggagcuacaucgcccuggauuccgguaaaggcaacugggacuguauuaugacuucauaccaguaucuuaucauccagaacaccacaugggaagaucacugccaguuuagucggccgagccccauuggguaccugggauugcucucucaacgcacucgagacauauauaucucccguagacuguuaggcaccuucacauggacccugucagauagcgaggguaaugaaacgccugggggauacugucucacuagguggaugcuuauugaggcggagcugaagugcuuuggcaacacagcaguugccaaauguaaugaaaagcaugacgaggaguucugcgauauguugcggcuauuugacuucaacaaacaggcuauccgcagacugaagaccgaagcccagaugaguauacagcucauuaauaaggcagugaacgcucugaucaaugaucaacuuaucaugaaaaaccaccugagggacauuaugggcaucccauauugcaauuacucuaaguauugguacuugaaccacuccgucacugggcggacaagccucccccgcuguuggcuggugucgaauggaucuuacuuaaacgaaacccaguucuccgacgauauugagcagcaagccgacaauaugauaacggagaugcugcagaaagaauauaucgaucgacaggguaagaccccucuaggccucguagaccuguuuguuuucucaacaaguuuuuaccuuauuagcaucuucuugcaucugaucaaaauuccaacucacagacauauaguggggaagcccugcccuaaaccacacaggcucaaccauaugggaaucuguuccugcggccuguauaagcacccggguauucccgucaaguggaaacgguga

SEQ ID NO: 1614 - RNA, 1473 nt, Artificial Sequence
  derived and/or modified CDS sequence (opt3) from Lassa virus__AIT17538__GPC
augggccagaucauuaccuucuuucaagaggugccccacgucauagaagagguuaugaacaucgugcugauugcccucagccuucuggcuaucuugaaggggauuuacaauaucgcaacaugcggauuauucggucugauauccuuucuacuccuguguggcagaucuugcucaacuacguauaaagggguauacgaacuucagacccuggaguuggacauggccaaccucaauaugacaaugccucugaguuguacuaagaacaauagccaucacuauaucauggugggaaacgaaaccggccuggagcucacauuaaccaauacuuccauuaucaaccauaaauucugcaaucugucugaugcgcacaagaaaaaccuuuacgaccaugcuuugaugucgauuaucucaacauuucaccugagcauaccaaauuucaaccaguaugaggccaugaguugugauuuuaaugaagguaagauuuccguccaguacaaccuaucucacagcuaugcaaucgacgccgcugggcauugcggaaccauugcaaauggcgugcuccaaacguucaugaggauggccuggggcggguccuacaucgcucuggauucaggaaaggguaacugggacuguaucaugaccaguuaccaguaucuuauuauacagaacacuacaugggaggaucacugccaguuuagccggccgucucccaucggcuaccugggguugcucucccaacgcacucgagacauuuauaucucacguagacuguuaggaaccuucacauggacccugagcgauagugaaggcaaugaggccccugguggguacugucucacgagguggaugcuuauagaggcggaacugaaaugcuuuggaaacacugcaauugccaaguguaaugagaaacaugacgaagaguucugcgauauguugcggcuauuugacuucaacaagcaggcuaucaaacgccugaaggccgaagcacagaugucuauccaccucauuaauaaggcuguuaacgcccugaucaaugaucagcuuauuaugaaaaaccaccugagagacauaaugggcaucccauauugcaauuacuccaaguauugguacuugaaccauacagugaccggcaaaacuagccuccccaaguguuggcuggucucgaaugggucuuacuuaaacgagacacacuucuccgacgauauugagcaacaggcggacaauaugaucaccgaacugcuacagaaagaguauauggauaggcaaggaaagacgccucucggucugguggaccuuuuuguauucucaaccaguuuuuacuugaucagcauuuuccugcaucucguuaaaauaccaacacaccggcauaucgugggccgccccugcccuaagccacaccgacugaaccacauggggauuuguuccugcggacuuuauaagcauccgggcguccccgugaaauggaagagauga

SEQ ID NO: 1615 - RNA, 1473 nt, Artificial Sequence
  derived and/or modified CDS sequence (opt3) from Lassa virus__AIT17540__GPC
augggccagaucgugaccuucuuucaagaggucccccacguuauugaagagauaaugaacaucgugcugauuacacucagccuucuggccaucuugaaggggauuuacaauuucgcuacuugcggauuaaucggucugauaacguuucuauuccucuguggcagauccugcucuaccaucuauaaagggucauaccagcugcagacacuugaacugaacauggagacuuugaauaugaccaugccucucaguuguacaaagaacaauagccaucacuauauuaggguaggaaacgaaaccggccuggagcugacucucacaaauaccuccaucauuaaccauaaauuuugcaauuuaucugaggcacacaagaaaaaccuguacgaccaugcccuuaugucgaucauaucaacguuccacuugagcauuccaaauuuuaaccaguaugaagcgaugaguugugauuucaauggugggaagaucuccgugcaauacaaccugucucacagcuaugcugucgacgccgcaaaucauugcggaacuguggccaacggcguucuacagaccuuuaugcggauggcuuggggcggguccuacauugcacucgauucaggacgcgguaacugggacuguaucaugacaaguuaccaguaucugaucauucagaauacuaccugggaggaucacugccaauucagccgaccgucucccauaggcuaccuugggcuguugucccagcguacaagagacaucuauauuucaaggcggcuccugggaaccuuuacguggacuuuaagcgauagugaaggcaaggagacaccugguggguacugucugacccgcuggaugcucaucgaggccgaacuuaaaugcuucggaaacacugcuguggccaaguguaaugagaaacaugacgaagaguuuugcgauaugcugagauuguucgacuucaacaagcaggcgauacagaggcuaaaaacagaagcacaaaugucuauucagcugaucaauaaggccgucaacgcucucaucaaugaucagcugauuaugaagaaccaccuucgggacaucaugggcauuccauauugcaauuacuccaaauauugguaccugaaccacaccagcacgggccgcaccucguugcccaaguguuggcucgugucuaauggguccuaccugaacgagacacauuuuucagaugacauagagcaacaggccgacaauaugaucacugaaauguuacagaaagaguauauugaucgacagggaaagaccccucugggucuaguagaccucuucguuuuuaguacuagcuucuaccugaucuccaucuuucuucacuuggugaaaauuccaacacauagacacauagucggcaagucuugccccaaaccucauaggcugaaccacauggggaucuguagcugcggacucuauaagcaaccaggcgugccggugaaguggaaacgguga

SEQ ID NO: 1616 - RNA, 1473 nt, Artificial Sequence
  derived and/or modified CDS sequence (opt3) from Lassa virus__AIT17544__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacaugggaagucucaacaugacaaugccucugagcuguacuaagaauaacucccaucacuauaucauggugggcaaugaaaccggucuggagcucacauuaaccaacacuucuauaaucaaucauaaauucugcaaccugucggaugcccacaagaaaaaucuuuacgaccaugcguugaugucaauuaucagcacauuucaccugaguauuccaaacuucaaucaguaugaggcuauguccugugauuuuaacgggggaaagaucucuguucaguacaaucuaagccacuccuaugccguggacgcagccaaccauugcggcaccauagcuaauggcguccuccaaacguucaugaggauggcauggggagggucauacauugcccuggauagugguaagggcagcugggacuguaucaugacuucuuaccaguaucuuauuauccagaacaccacaugggaagaucacugccaguuuucccggccgucacccaucggguaccugggauugcucagccaacgcacucgagacauuuauauaagucguagacuguuaggcaccuucacauggacccugucugauuccgaggguaacgaaacgccugggggauacugucucacuagguggaugcuuaucgaggcugagcugaaaugcuuuggcaauacagccguggcgaaguguaacgaaaaacaugacgaggaguucugcgauauguugcggcuauuugacuucaauaagcaggcaauucgcagacugaaaaccgaagcccagaugagcauccagcucauaaacaaggcuguaaaugcccugauuaacgaucaacuuaucaugaagaaucaccugagggacaucaugggcauuccauauugcaacuacucgaaauauugguacuugaaucacacuguuacagggaagaccucucucccccgguguuggcugguguccaacggaucauacuuaaaugaaacgcauuucagugacgauaucgagcagcaggcagacaacaugauuaccgagcugcuacaaaaagaauauauggaucgccaggguaagacaccucucggccuggucgaccuuuuuguguucagcacuuccuuuuacuugauaucuaucuuccugcaccucgugaaaauuccaacccaucgacacaucaucgggaagcccugcccuaaaccacauagacugaaucacaugggaauuuguagcugcggccuuuauaagcacccggguguccccguuaaguggaaaagguga

SEQ ID NO: 1617 - RNA, 1473 nt, Artificial Sequence
  derived and/or modified CDS sequence (opt3) from Lassa virus__AIT17548__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuauuccucuguggcagaucuugcucaacuacguauaaaggggucuacgaacugcagacccuugagcuggacauggccaguuugaacaugacaaugccucucagcuguacuaagaauaacucccaucacuauaucauggugggaaaugaaaccggccuggagcugacacucaccaacacuucuauaaucaaucauaaauuuugcaacuuaucggaugcgcacaagaggaaucuguacgaccaugcucuuaugucaauuaucagcacauuccacuugaguauuccaaacuuuaaucaguaugaggccauguccugugauuucaacggugggaaaaucucuguucaguacaaucugagccacgcauaugccggagacgcugcaaagcauugcggcaccauagccaacggcgugcuacaaacguuuaugcggauggcuuggggaggguccuacauugcccucgauucagguaagggcaguugggacuguaucaugacuagcuaccaguaucugauuauccagaauaccacaugggaagaucacugccaguucucucgcccgucccccaucggguaccuuggacuguugucacaacgaacucgugacauuuauauaagcagaaggcuccugggcaccuuuacauggaccuuaagugauucugaggguaacgaaacgccugggggauacugucugacucgguggaugcucaucgaggcggagcuuaaaugcuucggcaacacagcagucgccaaguguaaugaaaaacaugacgaggaauuuugcgauaugcugcgcuuguucgacuucaacaagcaggcuauuagaaggcuacggaccgaggcccagauguccauccagcugauaaauaaagcagugaacgcucucauuaaugaucaacugaucaugaagaaccaccuucgcgacaucaugggcauuccauauugcaauuacagcaaguauugguaccugaaccacacuguaacagggaaaaccucguugcccaaguguuggcucguuucuaauggauccuaccugaacgaaacgcauuuuucagacgauaucgagcagcaggccgacaauaugauuaccgagauguuacaaaaagaauauauagaucgacaggguaagacaccucugggccuaguggaccucuucgucuuuaguacuagcuucuaccugaucuccauuuuucuucacuuggugaaaaucccaacccauagacacgugaucgggaagcccugcccuaaaccacauaggcugaaccacaugggaauuuguucuugcggccucuauaagcacccggguguccccguuaaguggaaacgguga

SEQ ID NO: 1618 - RNA, 1473 nt, Artificial Sequence
  derived and/or modified CDS sequence (opt3) from Lassa virus__AIT17552__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccgugaacgcugcaaaucauugcggaaccauagccaacggcguccuccaaacguucaugaggauggcuuggggcggguccuacauugcccuggacucaggaaaggguaguugggauuguaucaugacuagcuaccaguaucuuauuauccagaacaccacaugggaagaccacugccaguuuucucggccgucccccaucggcuaccugggguugcucucacaacgcacucgagauauuuauauaagccguagacuguuaggaaccuucacauggacccugagugacucugagggcaaugaaacgccugguggguacugucucacuagguggaugcuuaucgaggcggagcugaaaugcuuuggaaacacagcaguggccaaguguaaugaaaaacaugaugaggaguucugcgacauguugcggcuauuugauuucaacaagcaggcuauucgcagacugaaaaccgaagcccagauguccauccagcucauaaauaaggcaguaaacgcucugauuaaugaccaacuuaucaugaagaaccaccugagggauaucaugggcauuccauauugcaauuacagcaaauauugguacuugaaccacacuguuacaggcaagaccucgcucccccgguguuggcuggugucuaauggguccuacuuaaacgaaacgcauuucucagacgacaucgagcagcaggccgauaauaugauuaccgagcugcuacaaaaagaauauauggaccgccagggaaagacaccucucggucuggucgaucuuuuuguguucaguacuagcuuuuacuugauauccaucuuccugcaccucgugaaaauuccaacccaucgacacgucaucggcaagcccugcccuaaaccacauagacugaaccacauggggaucuguucuugcggacuuuauaagcacccgggcguucccgugaaguggaaaaaguga

SEQ ID NO: 1619 - RNA, 1473 nt, Artificial Sequence
  derived and/or modified CDS sequence (opt3) from Lassa virus__AIT17556__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggacgggguaguugggacuguaucaugaccagcuaccaguaucuuauuauccagaacacaacuugggaagaucacugccaguuuucucgcccgucccccaucggcuaccugggguugcucucacaacgaacccgugacauuuauauaagcagaaggcuguuaggaacauucaccuggacgcugagugauucugagggcaacgaaacuccugguggguacugucucacacgguggaugcuuaucgaggccgagcugaagugcuuuggaaauaccgcgguggcaaaauguaacgaaaagcaugacgaggaguucugcgauauguugcgccuauuugacuucaauaaacaggccauuagaaggcugaagacugaagcucagauguccauccagcucauaaacaaagccguaaaugcacugauuaacgaucaacuuaucaugaagaaucaucugcgggacaucaugggcauuccauauugcaacuacagcaaguauugguacuugaaucacacaaucaccggcaaaacgucgcucccccgcuguuggcugguuucuaacggguccuacuuaaaugaaacccacuucucagacgauauugagcagcaggcugacaacaugauaacagagcugcuacaaaaggaauauaucgaucgacagggaaaaacuccucucggucugguggaccuuuuugucuucaguaccagcuuuuacuugauuuccaucuuccugcaccucgugaagaucccaacacauagacacauuacuggcaaacccugcccuaagccacauaggcugaaucacauggggauauguucuugcggacuuuauaaacacccgggcgugcccguccgguggaagcguuga

SEQ ID NO: 1620 - RNA, 1473 nt, Artificial Sequence
  derived and/or modified CDS sequence (opt3) from Lassa virus__AIT17560__GPC
augggccagaucauuaccuucuuucaagaggugccccacgucauagaagagguuaugaacaucgugcugauugcccucagccuucuggcuguauugaaggggaucuacaauguggcaacaugcggauuauucggucuggucuccuuucuacuccuguguggcagaucuugcucaacuacguauaaagggguguacgaacuucagacccuggaguuggacauggccagucucaacaugacaaugccucugagcuguacuaccaauaacucccaucacuauauuaugguuggaaaugaaacaggccuggagcucaccuuaacuaacacaucuaucauaaaucauaaguucugcaaccugucggaugcgcacaaaaagaaucuuuacgaccaugcuuugaugucaaucauuagcaccuuucaccugaguaucccaaacuucaaucaguaugaggccauguccugugauuuuaacggugggaaaauuucugugcaguacaaucuaagccacgcauaugccggagaagcugcaaaccauugcggcacgaucgccaauggcguccuccaaacuuucaugaggauggcuuggggaggguccuacauagcccuggacucagguaagggcaguugggauuguauuaugaccagcuacaaguaucuuaucauucagaacacaacuuggggagaccacugccaguuuucucggccgucccccaucggguaccugggcuugcucucacagcgcacccgagauaucuauauuagccguagacuguuagguacauucaccuggacgcugagugacucugaggggaacgaaacuccuggaggcuacugucucacaagguggaugcuuauagaggcggagcugaaaugcuuuggcaauaccgcaguggccaaguguaacgaaaaacaugaugaggaguucugcgacauguugcggcuauuugauuucaauaagcaagcuauccgcaaacugaagacugaagcccagauguccauucagcucaucaacaaggcaguaaaugcucugauaaacgaccagcuuauuaugaaaaaucaccugagagauaucauggggaucccauauugcaacuacagcagguauugguacuugaaucacacaguuaccggacggacgucgcucccccgcuguuggcuggugucuaacgguuccuacuuaaaugaaacccauuucucagacgacauugagcaacaggccgauaacaugaucacagagcugcuacagaaggaauauauugaccgacaaggcaaaacuccucucgggcuggucgaucuuuuuguguucaguaccagcuuuuacuugauauccaucuuccugcaccucgugaagauuccaacacauagacacaucaucggaaaacccugcccuaagccacauaggcugaaucacaugggcauuuguucuugcggucuuuauaaacacccggggguccccguuaaguggaagcgguga

SEQ ID NO: 1621 - RNA, 1473 nt, Artificial Sequence
  derived and/or modified CDS sequence (opt3) from Lassa virus__AIT17564__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugcuauccuuucuccugcuuuguggcagaucuugcucaacuacguauaaagggguguacgaacugcagaccuuggagcucgacauggccagucugaacaugacaaugccucugagcuguacuaagaauaacucccaucacuauaucauggucggaaaugaaaccggccucgaguuaacacugaccaacacuucuauaaucaaucauaaauucugcaaccuuucggaugcgcacaagaaagacuuguacgaucaugcucugaugucaauuaucagcacauuucaccuaaguauuccaaauuucaaccaguaugaggccauguccugugacuuuaauggugggaagaucucugugcaguacaaccucagccacgcauaugccguugaugcugcaaagcauugcggaaccauagccaauggcgugcugcaaacguucaugaggauggcuuggggcggguccuacauugcccuugacucaggaaaagguaguugggauuguaucaugacuagcuaccaguaucugauuauccagaacaccucuugggaagaccacugccaguuuucccggccgucacccaucggcuacuuggggcuccugagccaacgcacacgagauauuuauauaagucguagauuacugggaacuuucaccuggacacucucugacuccgagggcaaugaaaccccugguggguacugucuuacgagguggaugcugaucgaggcggaguugaagugcuuuggaaacacugcagucgccaaauguaacgaaaagcaugaugaggaguucugcgacaugcuacggcuguuugauuucaauaaacaggcuauuaagcgccucaagacagaagcccagaugagcauccagcugauaaacaaagcagugaaugcucuuauuaacgaccaacugaucaugaagaaucacuugagagacaucaugggcauuccauauugcaacuacucgaaauauugguaccucaaucacaccguaacuggcaagacaucucugcccagguguugguuaguuuccaacgggucauaccugaaugaaacccauuucagugaugacaucgagcagcaggccgauaacaugauuacggagcuacuccaaaaagaauauauagaccggcagggaaagaccccucugggucuuguggauuuguuugucuucagcacauccuuuuaccugaucucuauuuuccuccaccuggugaaaaucccaacucaucgccacgugaucggcaagcccugcccuaagccacaucgacuuaaucacauggggauuuguagcugcggacuguauaaacacccgggcguccccguuaaguggaaaagauga

SEQ ID NO: 1622 - RNA, 1473 nt, Artificial Sequence
  derived and/or modified CDS sequence (opt3) from Lassa virus__AIT17572__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccaaccucaauaugacaaugccucugaguuguacuaagaacaauagccaucacuauaucauggugggaaacgaaaccggccuggagcucacauuaaccaauacuuccauaaucaaccauaaauucugcaaucugucugaugcgcacaagaaaaaccuuuacgaccaugcuuugaugucgauuaucucaacauuucaccugagcauuccaaauuucaaccaguaugaggccaugaguugugauuuuaauggugggaagaucuccguucaguacaaccuaucucacaauuaugcaguggacgccgcuaaccauugcggaaccauagcaaacggcguccuccaaacguucaugaggauggccuggggcgggagcuacauugcucuggauuccggaaaggguaauugggacuguaucaugacuucauaccaguaucuuauuauccagaacaccacaugggaagaucacugccaguuuagucggccgagccccaucggcuaccugggguugcucucucaacgcacucgagacauuuauauaucccguagacuguuaggaaccuucacauggacccugucagauagcgagggcaaugacaugccugguggguacugucucacgagguggaugcuuaucgaagccgagcugaaaugcuuuggaaacacugcgguggcaaaguguaaugagaaacaugaugaagaguucugcgacauguugcggcuauuugauuucaacaagcaggccauucgcagacugaaaacagaagcucagaugaauauccagcucauaaacaaggccguaaaugcacugauuaacgaccaacuuaucaugaagaaucaccugagggacaucaugggcauuccauauugcaacuacaguaaauauugguacuugaaucacaccguuacuggcaagacaucucucccccgguguuggcugguguccaacgggagcuacuuaaaugagacccauuucucggaugacaucgaacagcaggcugauaacaugauuacggagcugcuacaaaaagaguauauggaccgccagggaaagaccccucucggucuggucgaucuuuuuguguucucuacauccuuuuacuugauaucaaucuuccugcaccucgugaaaauuccaacucaucgacacaucaucggcaagcccugcccuaaaccacauagacugaaccacauggggauuuguaguugcggacuuuauaagcacccgggcguccccguuaaguggaaaagguga

SEQ ID NO: 1623 - RNA, 1473 nt, Artificial Sequence
  derived and/or modified CDS sequence (opt3) from Lassa virus__AIT17576__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaacugggacuguaucaugaccaguuaccaguaucuuauuauccagaacacaacuugggaagaucacugccaguuuagccggccgucucccaucggcuaccugggguugcucucccaacgcacccgagacauuuauauaucacguagacuguuaggaacauucaccuggacgcugagcgauagugagggcaaugaaacuccugguggguacugucucacaagguggaugcuuaucgaggccgagcugaaaugcuuuggaaacaccgcgguggcaaaguguaaugaaaaacaugacgaggaguucugcgauauguugcggcuauuugacuucaacaagcaggccauuucucgccugaaaacugaagcucagauguccauccagcucauaaauaaggccguaaacgcacugauuaaugaucaacuuaucaugaagaaccaccugagagacaucaugggcauuccauauugcaauuacagcaaauauugguacuugaaccacacaguuaccggcaagacgucgcuccccagguguuggcuggugucuaauggguccuacuuaaacgaaacccauuucucagacgauaucgagcagcaggcugacaauaugauuacagagaugcugcaaaaagaauauauagaucggcagggaaagacuccucuaggucucgucgaccuguuuguguucaguaccagcuuuuaccuuaucuccauuuucuugcaccuggugaaaaucccaacacaucgccacaucacuggcaagcccugcccuaaaccacaucgacucaaccacauggggauuuguucuugcggacuguauaagcacccgggcguccccguuaaguggaaaagauga

SEQ ID NO: 1624 - RNA, 1473 nt, Artificial Sequence
  derived and/or modified CDS sequence (opt3) from Lassa virus__AIT17580__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugaguccaacgaaacuccuggcgguuacugucucacaagguggaugcuuaucgaggccgagcugaaaugcuuugggaauaccgcgguggcaaaguguaacgaaaaacaugacgaggaguucugcgauauguugcggcuauuugacuucaauaagcaggccauucgcagacugaaagcugaagcccagaugagcauccagcucauaaacaaggcaguaaaugcucugauuaacgaucaacuuaucaugaagaaucaccugagggacaucaugggcauuccauauugcaacuacucgaaauauugguacuugaaucacacuguuacaggacggaccucucucccccgcuguuggcugguguccaacggcucauacuuaaaugaaacgcauuucagugacgauaucgagcagcaggccgacaacaugauuaccgagcugcuacaaaaggaauauauggaucgacaggggaaaacaccucucggacuggucgaccuuuuuguguucagcacuuccuuuuacuugauaucuaucuuccugcaccucgugaagauuccaacccauagacacgucaucgguaaacccugcccuaagccacauaggcugaaucacaugggcaucuguagcugcgggcuuuauaaacacccgggaguucccgugaaguggaagcgguga

SEQ ID NO: 1625 - RNA, 1473 nt, Artificial Sequence
  derived and/or modified CDS sequence (opt3) from Lassa virus__AIT17584__GPC
augggccagaucauuaccuucuuucaagaggugccccaggucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaccauuauaucauggugggaaaugaaaccggccuggagcucacauuaaccaaccagucuauaaucaaucacaaauucugcaaccugucggaugcgcauaagaaaaaucuuuacgaccacgcuuugaugucaauuaucagcacuuuucaucugaguauuccaaacuucaaucaauaugaggccauguccugugauuuuaacggugggaagaucucuguucaguacaaucuaagccacuccuucgcaguggacgccgcuaaccacugcggaacaauagcaaauggcguccuccagaccuuuaugaggauggccuggggcgggucauauauugcucuggauaguggaaaggguagcugggacuguaucaugacgucuuaccaguaccuuauuauccaaaacacuaccugggaagaucauugccaguucucccggccgucacccaucggcuaucugggguugcucagccagcgcacacgagacauuuacauaagucguagacuguuaggaacuuuuaccuggacacugucugauuccgagggcaacgaaaccccugguggguauugucucacgagguggaugcuuaucgaggccgagcugaaaugcuucggaaauacugcgguggcaaaguguaacgaaaaacacgacgaggaauuuugcgauauguugcggcuauucgacuucaauaagcaggccauucgcagacugaaaacagaggcucaaaugagcauccagcucauaaacaaggccguaaaugcacugauuaacgaucagcuuaucaugaagaaucaucugagggacaucaugggcauuccauacugcaacuauucgaaauacugguauuugaaucacaccaagacuggcaaaacaucucucccccgguguuggcugguuuccaacgggucauacuuaaaugaaacccacuuuagugacgauaucgagcaacaggcugacaacaugauuacggagcugcuacagaaggaauacauggaucgccagggaaaaaccccucucggucugguggaccuuuucgucuuuagcacauccuucuauuugauaucuaucuuucugcaucucgugaagauuccaacucaccgacaugugaucggcaaacccugcccuaagccacacagacugaaucauauggggaucuguagcugcggacuuuacaagcacccgggcguccccguuaaauggaagagguga

SEQ ID NO: 1626 - RNA, 1473 nt, Artificial Sequence
  derived and/or modified CDS sequence (opt3) from Lassa virus__AIT17588__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaguugggacuguaucaugacuagcuaccaguaucuuauuauccagaacaccacaugggaagaucacugccaguuuucucggccgucccccaucggcuaccugggguugcucucacaacgcacucgagacauuuauauaagccguagacuguuaggaaccuucacauggacccugagugauucugagggcaacgaaacgccugguggguacugucucacuagguggaugcuuaucgaggcggagcugaaaugcuuuggaaauacagcaguggccaaguguaacgaaaaacaugacgaggaguucugcgauauguugcggcuauuugacuucaauaagcaggcuauucgcagacugaaagccgaagcacagauguccauccagcucauaaacaaggcuguaaaugcccugauuaacgaucaacuuaucaugaagaaucaccugagggacaucaugggcauuccauauugcaacuacagcaaauauugguacuugaaucacaccguuacuggcaagacaucgcucccccgguguuggcuggugucuaacggguccuacuuaaaugaaacccauuucucagacgauaucgagcagcaggcggacaacaugauuacggagcugcuacaaaaagaauauauagaucgccagggaaagaccccucucggucuggucgaccuuuuuguguucaguacuagcuuuuacuugaucuccauuuuccugcaccucgugaaaaucccaacacaucgacacgucaucggcaagcccugcccuaaaccacauagacugaaucacauggggauuuguucuugcggacuuuauaagcacccgggcguucccgugaaguggaaaagguga

SEQ ID NO: 1627 - RNA, 1473 nt, Artificial Sequence
  derived and/or modified CDS sequence (opt3) from Lassa virus__AIT17592__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccauacauugaugucaauuaucagcaccuuucaccugaguauuccaaacuucaaucaguaugaggcuauguccugugauuuuaacggugggaggaucucuguucaguacaaucuaagccacgccuaugcaguggacgccgcuaaccauugcggaacgauagcaaauggcguccuccaaacuuucaugcggauggccuggggcggguccuacauugcucuggauucaggaaaggguaguugggacuguaucaugaccagcuaccaguaucuuauuauccagaacacaacuugggaagaucacugccaguuuucucgcccgucccccaucggcuaccugggguugcucucacaacgaacccgugacauuuauauaagcagaaggcuguuaggaacauucaccuggacgcugagugauucugagggcaacgaaacuccugguggguacugucucacacgguggaugcuuaucgaggccgagcugaagugcuuuggaaauaccgcgguggcaaaauguaacgaaaagcaugacgaggaguucugcgauauguugcgccuauuugacuucaauaaacaggccauuagaaggcugaagacugaagcucagauguccauccagcucauaaacaaagccguaaaugcacugauuaacgaucaacuuaucaugaagaaucaucugcgggacaucaugggcauuccauauugcaacuacagcaaguauugguacuugaaucacacaaucaccggcaaaacgucgcucccccgcuguuggcugguuucuaacggguccuacuuaaaugaaacccacuucucagacgauauugagcagcaggcugacaacaugauaacagagcugcuacaaaaggaauauaucgaucgacagggaaaaacuccucucggucugguggaccuuuuugucuucaguaccagcuuuuacuugauuuccaucuuccugcaccucgugaagaucccaacacauagacacguggucggcaaacccugcccuaagccacauaggcugaaucacauggggauuuguucuugcggacuuuauaaacacccgggcguucccgugaaguggaagcgguga

SEQ ID NO: 1628 - RNA, 1473 nt, Artificial Sequence
  derived and/or modified CDS sequence (opt3) from Lassa virus__AIT17596__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaucuugggaagaucacugccaguuuucccggccgucacccaucggcuaccugggguugcucagccaacgcacucgagacauuuauauaagucguagacuguuaggaaccuucacauggacccugucugauuccgagggcaacgaaacgccugguggguacugucucacuagguggaugcuuaucgaggccgagcugaaaugcuuuggaaauacagcgguggcaaaguguaacgaaaaacaugacgaggaguucugcgauauguugcggcuauuugacuucaauaagcaggccauucgcagacugaaaaccgaagcucagaugagcauccagcucauaaacaaggccguaaaugcacugauuaacgaucaacuuaucaugaagaaucaccugagggacaucaugggcauuccauauugcaacuacucgaaauauugguacuugaaucacacuguuacaggcaagaccucucucccccgguguuggcugguguccaacgggucauacuuaaaugaaacgcauuucagugacgauaucgagcagcaggcugacaacaugauuaccgagcugcuacaaaaagaauauauagaucgccagggaaagacaccucucggucuggucgaccuuuuuguguucagcacuuccuuuuacuugaucucuauuuuccugcaccucgugaaaaucccaacccaucgacacgucaucggcaagcccugcccuaaaccacauagacugaaucacauggggauuuguagcugcggacuuuauaagcacccgggcguucccgugaaguggaaaagguga

SEQ ID NO: 1629 - RNA, 1473 nt, Artificial Sequence
  derived and/or modified CDS sequence (opt3) from Lassa virus__AIT17600__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccggagacgcugcaaaccauugcggcaccauagccaauggcgugcuccaaacguucaugaggauggcuuggggaggguccuacauugcccuggauucagguaagggcaguugggacuguaucaugacuagcuaccaguaucuuauuauccagaacaccacaugggaagaucacugccaguuuucucggccgucccccaucggguaccugggauugcucucacaacgcacucgagacauuuauauaagccguagacuguuaggcaccuucacauggacccugagugauucugaggguaacgaaacgccugggggauacugucucacuagguggaugcuuaucgaggcggagcugaaaugcuuuggcaauacagcagucgccaaguguaacgaaaaacaugacgaggaguucugcgauauguugcggcuauuugacuucaauaagcaggcuauucgcagacugaaaaccgaagcccagauguccauccagcucauaaacaaggcagugaaugcucugauuaacgaucaacuuaucaugaagaaucaccugagggacaucaugggcauuccauauugcaacuacagcaaauauugguacuugaaucacacuguaacagggaagaccucgcucccccgguguuggcugguuucuaacggauccuacuuaaaugaaacgcauuucucagacgauaucgagcagcaggccgacaacaugauuaccgagcugcuacaaaaagaauauauagaucgccaggguaagacaccucucggccugguggaccuuuuugucuucaguacuagcuuuuacuugaucuccauuuuccugcaccucgugaaaaucccaacccaucgacacgugaucgggaagcccugcccuaaaccacauagacugaaucacaugggaauuuguucuugcggccuuuauaagcacccggguguccccguuaaguggaaaagguga

SEQ ID NO: 1630 - RNA, 1473 nt, Artificial Sequence
  derived and/or modified CDS sequence (opt3) from Lassa virus__AIT17604__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacaugacaagucucaacaugacuaugccucugagcuguaccaagaauaacucccaucacuauaucauggugggaaaugaaacaggccuggagcucaccuuaacuaacacaucuauaaucaaucauaaauucugcaaccugucggaugcccacaagaaagaccuuuacgaucaugcguugaugucaauuaucagcaccuuucaccugaguauuccaaauuucaaccaguaugaggcuauguccugugacuuuaauggugggaagaucucuguucaguacaaccuaagccacacguaugccguggaugcagccaagcauugcggaacuauagcuaauggcguccuccaaaccuucaugaggauggcauggggcggguccuacauugcccuggacucaggaaaagguaguugggauuguaucaugacaagcuaccaguaucuuauuauccagaacacuaccugggaagaccacugccaguuuucucggccgucccccgugggcuaccugggguugcucucacaacgcacacgagauaucuauauuagccguagacuguuaggaaccuucacguggacucugagugacucugagggcaaugaaacaccugguggguacugucucaccagguggaugcuuauagaggcugagcugaagugcuuuggaaacacugccguagcgaaauguaacgaaaagcaugaugaggaguucugcgacauguugcggcuauuugauuucaauaaacaggcaauccgcagacugaagacagaagcccagauguccauucagcucaucaacaaggcuguuaaugcccugauaaacgaccaacuuauuaugaaaaaucaccugagggacaucaugggcaucccauauugcaacuacagcaaguauugguacuugaaucacaccgugacgggcaaaaccucgcucccccgguguuggcuggucucuaacggguccuacuuaaaugaaacacauuucucagaugacauugagcagcaggcagauaacaugaucacugagcugcuacaaaaggaauaucucgaccgccagggaaaaaccccucugggucuuguggauuuguuuguguucaguacuagcuuuuaccugauuuccauauuccuccaccuggucaagaucccaacacaucgacacguuauuggcaaacccugcccuaagccacauagacuuaaucacauggggaucuguucuugcggacuguauaagcacccgggcgugcccguaaaauggaagagguga

SEQ ID NO: 1631 - RNA, 1473 nt, Artificial Sequence
  derived and/or modified CDS sequence (opt3) from Lassa virus__AIT17608__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaggaaucuuuacaaccaugcuuugaugucaauuaucagcacauuucaccugaguauuccaaauuucaaccaguaugaggccauguccugugacuuuaauggugggaaaaucucuguucaguacaaccuaagccacaccuaugcaguggaugccgcuaaucauugcggaacgauagcaaacggcguccuccaaacuuucaugcggauggccuggggcggguccuacauugcucuggacucaggaaaggguaguugggauuguaucaugaccagcuaccaguaucuuauuauccagaacacaacuugggaagaccacugccaguuuucucgcccgucccccaucggcuaccugggguugcucucacaacgaacccgugauauuuauauaagcagaaggcuguuaggaacauucaccuggacgcugagugacucugagggcaaugaaacuccugguggguacugucucacacgguggaugcuuaucgaggccgagcugaagugcuuuggaaacaccgcgguggcaaaauguaaugaaaagcaugaugaggaguucugcgacauguugcgccuauuugauuucaacaaacaggccauuagaaggcugaagacugaagcucagauguccauccagcucauaaauaaagccguaaacgcacugauuaaugaccaacuuaucaugaagaaccaucugcgggauaucaugggcauuccauauugcaauuacagcaaguauugguacuugaaccacacaguuaccggcaaaacgucgcucccccgcuguuggcuggugucuaauggguccuacuuaaacgaaacccacuucucagacgacaucgagcagcaggcugauaauaugauuacagagcugcuacaaaaggaauauauagaccgacagggaaaaacuccucucggucuggucgaucuuuuuguguucaguaccagcuuuuacuugaucuccauuuuccugcaccucgugaagaucccaacacauagacacaucauuggcaaacccugcccuaagccacauaggcugaaccacauggggauauguucuugcggacuuuauaaacacccgggcguccccguuaaguggcggcguuga

SEQ ID NO: 1632 - RNA, 1473 nt, Artificial Sequence
  derived and/or modified CDS sequence (opt3) from Lassa virus__AIT17612__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucagggugggaaaugaaaccggccuggagcucacauuaaccaacacuucuauaaucaaucauaaauucugcaaccugucggaugcgcacaagaaaaaucuuuacgaccauucauugaugagcauuaucaguacauuucaccuguccauuccaaacuucaaucaguaugaggcuaugucuugugauuuuaacggugggaagaucagcguucaguacaaucuaucccacaccuaugccguggacgcagccaaccauugcggaacgauagcuaauggcguccuccaaacuuucaugcggauggcauggggcgggucauacauugcccuggauaguggaaaggguaacugggacuguaucaugaccagcuaccaguaucuuauuauccagaacacaacuugggaagaucacugccaguuuucucgcccgucccccaucggcuaccugggguugcucucacaacgaacccgugacauuuauauaagcagaaggcuguuaggaacauucaccuggacgcugagugauucugagggcaaugaaacuccugguggguacugucucacacgguggaugcuuaucgaggcugagcugaaaugcuuuggaaacaccgccguggcgaaguguaaugaaaaacaugacgaggaguucugcgauauguugcgccuauuugacuucaacaagcaggcaauuagaaggcugaaaacugaagcccagauguccauccagcucauaaauaaggcuguaaacgcccugauuaaugaucaacuuaucaugaagaaccaucugcgggacaucaugggcauuccauauugcaauuacagcaaauauugguacuugaaccacacaguuaccggcaagacgucgcucccccgcuguuggcuggugucuaauggguccuacuuaaacgaaacccacuucucagacgauaucgagcagcaggcagacaauaugauuacagagcugcuacaaaaagaauauauagaucgacagggaaagacuccucucggucuggucgaccuuuuuguguucaguaccagcuuuuacuugaucuccauuuuccugcaccucgugaaaaucccaacacauagacacgucguuggcaagcccugcccuaaaccacauaggcugaaccacauggggaucuguucuugcggacuuuauaagcacccgggcgugcccguaaaguggaaacgguga

SEQ ID NO: 1633 - RNA, 1473 nt, Artificial Sequence
  derived and/or modified CDS sequence (opt3) from Lassa virus__AIT17616__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaaaccauugcggaaccauagccaauggcguccuccaaacguucaugaggauggcuuggggcggguccuacauugcccuggauucaggaaaggguaguugggacuguaucaugacuagcuaccaguaucuuauuauccagaacaccacaugggaagaucacugccaguuuucucggccgucccccaucggcuaccugggguugcucucacaacgcacucgagacauuuauauaagccguagacuguuaggaaccuucacauggacccugagugauucugagggcaacgaaacgccugguggguacugucucacuagguggaugcuuaucgaggcggagcugaaaugcuuuggaaauacagcaguggccaaguguaacgaaaaacaugacgaggaguucugcgauauguugcggcuauuugacuucaauaagcaggcuauucgcagacugaaaaccgaagcccagauguccauccagcucauaaacaaggcaguaaaugcucugauuaacgaucaacuuaucaugaagaaucaccugagggacaucaugggcauuccauauugcaacuacagcaaauauugguacuugaaucacacuguuacaggcaagaccucgcucccccgguguuggcuggugucuaacggguccuacuuaaaugaaacgcauuucucagacgauaucgagcagcaggccgacaacaugauuaccgagcugcuacaaaaagaauauauagaucgccagggaaagacaccucucggucuggucgaccuuuuuguguucaguacuagcuuuuacuugaucuccauuuuccugcaccucgugaaaaucccaacccaucgacacgucaucggcaagcccugcccuaaaccacauagacugaaucacauggggauuuguucuugcggacuuuauaagcacccgggcguucccgugaaguggaaaagguga

SEQ ID NO: 1634 - RNA, 1473 nt, Artificial Sequence
  derived and/or modified CDS sequence (opt3) from Lassa virus__AIT17620__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucucgcauaaauucugcaaucugucagaugcgcacaagaaaaaccuuuacgaccaugcuuugaugagcauuaucaguacauuucaccuguccauuccaaauuucaaccaguaugaggccaugucuugugauuuuaauggugggaagaucagcguucaguacaaccuaucccacgcauaugccauagacgcugcaaaucauugcggaaccguggccaacggcguccuccaaacguucaugaggauggcuuggggcgggucauacauugcccuggauaguggaaaggguagcugggacuguaucaugacuucuuaccaguaucuuauuauccagaauaccacaugggaagaucacugccaguuuucccggccgucacccaucggcuaccugggguugcucagccaacgcacucgagacauuuauauaagucguagacuguuaggaaccuucacauggacccugucugauuccgagggcaacgaaacgccugguggguacugucucacuagguggaugcuuaucgaggcggagcugaaaugcuuuggaaacacagcaguggccaaguguaaugaaaaacaugacgaggaguucugcgauauguugcggcuauuugacuucaacaagcaggcuauucgcagacugaaagccgaagcacagaugagcauccagcucauaaauaaggcuguaaacgcccugauuaaugaucaacuuaucaugaagaaccaccugagggacaucaugggcauuccauauugcaauuacucgaaauauugguacuugaaccacaccguuacuggcaagacaucucucccccgguguuggcugguguccaaugggucauacuuaaacgaaacccauuucagugacgauaucgagcagcaggcggacaauaugauuacggagcugcuacaaaaagaauauauggaucgccagggaaagaccccucucggucuggucgaccuuuuuguguucagcacauccuuuuacuugauaucuaucuuccugcaccucgugaaaauuccaacucaucgacacgucaucggcaagcccugcccuaaaccacauagacugaaccacauggggaucuguagcugcggacuuuauaagcacccgggcguucccgugaaguggaaaagguga

SEQ ID NO: 1635 - RNA, 1473 nt, Artificial Sequence
  derived and/or modified CDS sequence (opt3) from Lassa virus__AIT17626__GPC
augggccagaucauuaccuucuuucaagaggugccccacgucauagaagagguuaugaacaucgugcugauugcccucagccuucuggcuaucuugaaggggguauacaauguggcaacaugcggauuauucggucuggucuccuuucuacuccuguguggcagaucuugcucaacuacguauaaagggguguacgaacuucagacccuggaguuggacauggccagucucaacaugacaaugccucugagcuguacuaagaauaacucccaucacuauauuaugguuggaaaugaaaccggccuggagcucacauuaaccaacacuucuaucauacagcauaaauucugcaaucugucggaugcgcacaagaaaaaccuuuacgaccaugcuuugaugucaaucauuagcacauuucaccugaguaucccaaauuucaaccaguaugaggccauguccugugauuuuaauggugggaagauuaccgugcaauacaaccuaucucacagcuaugcaaucgacgccgcuaaucauugcggaacgauagcaaacggcguccuccagacuuucaugaggauggccuggggcggguccuacauugcucuggauucaggaaaggguaguugggacuguaucaugaccagcuaccaguaucuuauuauccagaauacaacuugggaagaucacugccaauuuucucggccgucccccaucggcuaccugggguugcucucacagcgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaacaccgcgguggcaaaguguaaugaaaaacaugacgaggaguucugcgauauguugcggcuauuugacuucaacaagcaggccauucgcagacugaaaacugaagcucagauguccauccaacucauaaauaaggccguaaacgcacugauuaaugaucagcuuaucaugaagaaccaccugagggacaucaugggcauuccauauugcaauuacagcaaauauugguacuugaaccacacaguuaccggccggacgucgcucccccgcuguuggcuggugucuaauggguccuacuuaaacgaaacccauuucucagacgauaucgagcagcaagcugacaauaugauuacagagcugcuacagaaggaauauauggaucgacagggaaaaacuccucucggucuggucgaccuuuuuguguucaguaccagcuuuuacuugauauccaucuuccugcaccucgugaagauuccaacacauagacacaucaucggcaaacccugcccuaagccacauaggcugaaccacaugggggucuguucuugcggacuuuauaaacacccgggcguucccgugaaguggaagcgguga

SEQ ID NO: 1636 - RNA, 1473 nt, Artificial Sequence
  derived and/or modified CDS sequence (opt3) from Lassa virus__AIT17630__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugcuauccuuucuccugcuuuguggcagaucuugcucaacuacguauaaagggguguacgaacugcagaccuuggagcucgacauggccagucugaacaugacaaugccucugagcuguacuaagaauaacucccaucacuauaucauggucggaaaugaaaccggccucgaguuaacacugaccaacacuucuauaaucaaucauaaauucugcaaccuuucggaugcgcacaagaaaaauuuguacgaccaugcucugaugucaauuaucagcacauuucaccuaaguauuccaaacuucaaucaguaugaggccauguccugugauuuuaacggugggaagaucucugugcaguacaaucucagccacgcauaugccguugacgcugcagaacauugcggaaccauagccaacggcgugcugcaaacguucaugaggauggcuuggggcggguccuacauugcccuugauucaggaaaggguaguugggacugugucaugacuagcuaccaguaucugaucauucagaauaccucuugggaggaucacugccaguuuucccggccgucacccaucggcuacuuggggcuccugagccaacgcacacgagacaucuauauuagucguagauuacugggaacuuucaccuggacacucucugauuccgaaggcaacgagaccccugguggguacugucuuacgagguggaugcugauagaggcggaauugaaaugcuuuggaaacacugcaguggccaaguguaaugagaaacaugacgaagaguucugcgauaugcuacggcuguuugacuucaacaagcaggcuauccgcagacucaaaacagaagcccagaugagcauucagcugaucaauaaggcaguaaacgcucuuauaaaugaucaacugauuaugaagaaccacuugagggacaucaugggcaucccauauugcaauuacucgaaauauugguaccucaaccacaccguuacuggcaagacaucucugccccgguguugguuaguguccaaugggucauaccugaacgagacccauuucagugacgauauugagcagcaggccgacaauaugaucacggaacuacuccaaaaagaguauauugaucgccagggaaagaccccucugggucuugucgacuuguuuguguucagcacauccuuuuaccugauaucuaucuuccuccaccuggugaaaauuccaacucaucgacacgucaucggcaagcccugcccuaaaccacauagacuuaaccacauggggaucuguagcugcggacuguauaagcacccgggcguucccgugaaguggaaaagguga

SEQ ID NO: 1637 - RNA, 1473 nt, Artificial Sequence
  derived and/or modified CDS sequence (opt3) from Lassa virus__AIT17634__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuaucuauaaagacgucuacgaacuucagacgcuggaguuggauauggccagucucaacaugaccaugccucugagcuguacaaagaauaacucccaucacuauauaaugguggggaaugaaacuggacuggagcucaccuuaacaaacaccucuaucauuaaucauaaauucugcaaccugucggacgcgcacaagaaaaaucuuuacgaucaugcuuugaugucaaucauuagcacuuuucaccugaguaucccaaacuucaaucaguaugaggccauguccugugacuuuaacggcgguaagauaucuguucaguacaaucuaagccacacauaugcaauugaugccgcuaaccauugcgggaccaucgcaaauggagugcuccaaacguucaugaggauggccuggggcggcuccuacauugcucuggacucagggaagggaaguugggauuguaucaugacuagcuaccaguaucuuaucauucagaacaccacaugggaagaccacugccaguuuucucggccgucccccauagguuaccugggcuugcucucacaacgcacucgagauaucuauauuagccguagacuguuagggaccuucacauggacccugagugacucugagggaaacgaaacgccuggcgguuacugucucacuagguggaugcuuaucgaggccgagcugaaaugcuuugggaauacagcggucgcaaaguguaacgaaaaacaugaugaggaguucugcgacauguugcggcuauuugauuucaauaagcaggccauacgcagacugaaaaccgaagcucagauguccauucagcucaucaacaaggccgugaaugcacugaucaacgaccaacuuauuaugaagaaucaccugagggacaucaugggcauuccauauugcaacuacagccgguauugguacuugaaucacacuguaacaggacgcaccucgcucccccgauguuggcugguuucuaacggcuccuacuuaaaugaaacgcauuucucagaugacauagagcagcaggcugauaacaugaucaccgagcugcuacaaaaagaauauauggacagacaggggaagacaccucucggacugguggaucuuuuugucuucaguacuagcuuuuacuugauuuccaucuuccugcaccucgugaaaaucccaacccauaggcacgugauugguaagcccugcccuaaaccacaucggcugaaucacaugggcauauguucuugcgggcuuuauaaccacccgggaguccccguuaaguggaaacguuga

SEQ ID NO: 1638 - RNA, 1473 nt, Artificial Sequence
  derived and/or modified CDS sequence (opt3) from Lassa virus__AIT17638__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaagaccuuuacgaucaugcuuugaugucaauuaucagcacauuucaccugaguauuccaaauuucaaccaguaugaggccauguccugugacuuuaauggugggaagaucucuguucaguacaaccuaagccacaccuaugcaguggaugccgcuaaucauugcggaacgauagcaaacggcguccuccaaacuuucaugaggauggccuggggcggguccuacauugcucuggacucaggaaaggguaguugggauuguaucaugaccagcuaccaguaucuuauuauccagaauacaacuugggaagaccacugccaguuuucucggccgucccccaucggcuaccugggguugcucucacaacgcacccgagauauuuauauaagccguagacuguuaggaacauucaccuggacgcugagugacucugagggcaacgaaacuccugguggguacugucucacaagguggaugcuuaucgaggccgagcugaaaugcuuuggaaacaccgcgguggcaaaguguaaugaaaaacaugaugaggaguucugcgacauguugcggcuauuugauuucaacaagcaggccauucgcagacugaaaacugaagcucagauguccauccagcucauaaauaaggccguaaacgcacugauuaaugaccaacuuaucaugaagaaccaccugagggacaucaugggcauuccauauugcaauuacagcaaauauugguacuugaaccacacaguuaccggcaagacgucgcucccccgguguuggcuggugucuaauggguccuacuuaaacgaaacccauuucucagaugacaucgagcagcaggcugauaauaugauuacagagcugcuacaaaaagaauauauggaccgccagggaaagacuccucucggucuggucgaucuuuuuguguucaguaccagcuuuuacuugauauccaucuuccugcaccucauuaaaaucccaacacaucgacacaucacuggcaagcccugcccuaaaccacauagacugaaccacauggggauuuguucuugcggacuuuauaagcacccgggcgugcccgucaaguggaaaagguga

SEQ ID NO: 1639 - RNA, 1473 nt, Artificial Sequence
  derived and/or modified CDS sequence (opt3) from Lassa virus__AIT17642__GPC
augggccagaucauuaccuucuuucaagaggugccccacgucauagaagagguuaugaacaucgugcugauugcccucagccuucuggcuaucuugaaggggguauacaauguggcaacaugcggauuauucggucuggucuccuuucuacuccuguguggcagaucuugcucaacuacguauaaagggguguacgaacuucagacccuggaguuggacauggccagucucaacaugacaaugccucugagcuguacuaagaauaacucccaucacuauauuaugguuggaaaugauaccggccuggaacucacauuaaccaacacuucuaucauaaaucauaaauucugcaaccugucggacgcgcacaagaaaaaucuuuacgaucaugcuuugaugucaaucauuagcacauuucaccugaguaucccaaacuucaaucaguaugaggccauguccugugacuuuaacggugggaagauuucugugcaguacaaucuaagccacgcauaugccgucgaugcugcaucccauugcggaaccaucgccaacggcgugcuccaaacguucaugaggauggcuuggggcgggucauacauagcccuggacaguggaaaggguagcugggauuguauuaugacuucuuaccaguaucuuaucauucagaauaccacaugggaggaccacugccaguuuucccggccgucacccaucggcuaccugggguugcucagccaacgcacucgagauaucuauauuagucguagacuguuaggaaccuucacauggacccugucugacuccgaaggcaacgagacgccugguggguacugucucacuagguggaugcuuauagaagcggagcugaaaugcuuuggaaacacagcaguagccaaguguaaugagaaacaugaugaagaguucugcgacauguugcggcuauuugauuucaacaagcaggcuauccgcagacugaaaaccgaagcccagaugagcauucagcucaucaauaaggcaguuaacgcucugauaaaugaccaacuuauuaugaagaaccaccugagggacaucaugggcaucccauauugcaauuacucgaaauauugguacuugaaccacacugugacaggcaagaccucucucccccgguguuggcuggucuccaaugggucauacuuaaacgagacgcauuucagugaugacauugaacagcaggccgauaauaugaucaccgagcugcuacaaaaagaguauauggaccgccagggaaagacaccucucggucugguggaucuuuuuguguucagcacuuccuuuuacuugauuucuauauuccugcaccucgucaaaaucccaacccaucgacacauuaucggcaagcccugcccuaaaccacauagacugaaccacauggggaucuguagcugcggacuuuauaagcacccgggcguucccgugaaguggaaaagguga

SEQ ID NO: 1640 - RNA, 1473 nt, Artificial Sequence
  derived and/or modified CDS sequence (opt3) from Lassa virus__AIT17646__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaucccauugcggaaccgucgccaacggcgugcuccaaacguucaugaggauggcuuggggcgggucauacauagcccuggauaguggaaaggguagcugggacuguauuaugacuucuuaccaguaucuuaucauucagaauaccacaugggaagaucacugccaguuuucccggccgucacccaucggcuaccugggguugcucagccaacgcacucgagacaucuauauuagucguagacuguuaggaaccuucacauggacccugucugauuccgagggcaacgaaacgccugguggguacugucucacuagguggaugcuuauagaggcggagcugaaaugcuuuggaaacacagcaguagccaaguguaaugaaaaacaugacgaggaguucugcgauauguugcggcuauuugacuucaacaagcaggcuauccgcagacugaaaaccgaagcccagaugagcauucagcucaucaauaaggcaguuaacgcucugauaaaugaucaacuuauuaugaagaaccaccugagggacaucaugggcaucccauauugcaauuacucgaaauauugguacuugaaccacacugugacaggcaagaccucucucccccgguguuggcuggucuccaaugggucauacuuaaacgaaacgcauuucagugacgauauugagcagcaggccgacaauaugaucaccgagcugcuacaaaaagaauauauggaucgccagggaaagacaccucucggucugguggaccuuuuuguguucagcacuuccuuuuacuugauuucuauauuccugcaccucgucaaaaucccaacccaucgacacguuauuggcaagcccugcccuaaaccacauagacugaaccacauggggaucuguagcugcggacuuuauaagcacccgggcgugcccguaaaguggaaaagguga

SEQ ID NO: 1641 - RNA, 1473 nt, Artificial Sequence
  derived and/or modified CDS sequence (opt3) from Lassa virus__AIT17650__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacauaucuaucauuaaucauaaauucugcaaccugucggaugcgcacaagaaaaaucuuuacgaccaugcuuugaugucaaucauuagcacuuuucaccugaguaucccaaacuucaaucaguaugaggccauguccugugauuuuaacggugggaagauaucuguucaguacaaucuaagccacacauaugcaguggacgccgcuaaccauugcggaaccauugcaaauggcguccuccaaacguucaugaggauggccuggggcggguccuacaucgcucuggauucaggaaaggguaguugggacuguauuaugacuagcuaccaguaucuuaucauccagaacaccacaugggaagaucacugccaguuuucucggccgucccccauuggcuaccugggguugcucucacaacgcacucgagacauauauaucagccguagacuguuaggaaccuucacauggacccugagugauucugagggcaacgaaacgccugguggguacugucucacuagguggaugcuuauugaggccgagcugaaaugcuuuggaaauacagcgguggcaaaguguaacgaaaaacaugacgaggaguucugcgauauguugcggcuauuugacuucaauaagcaggccauccgcagacugaaagcugaagcccagauguccauacagcucauuaacaaggcaguaaaugcucugaucaacgaucaacuuaucaugaagaaucaccugagggacauuaugggcaucccauauugcaacuacagcaaauauugguacuugaaucacaccguuacuggccggacaucgcucccccgcuguuggcuggugucuaacggguccuacuuaaaugaaacccauuucucagacgauauugagcagcaggccgacaacaugauaacggagcugcuacaaaaggaauauaucgaucgacagggaaaaaccccucucggucuggucgaccuuuuuguguucaguacuagcuuuuacuugauuuccaucuuccugcaccucgugaagaucccaacacauagacacauuauaggcaaacccugcccuaagccacauaggcugaaucacauggggaucuguucuugcggacuuuauaaacacccgggcguccccguuaaguggaagcgguga

SEQ ID NO: 1642 - RNA, 1473 nt, Artificial Sequence
  derived and/or modified CDS sequence (opt3) from Lassa virus__AIT17658__GPC
augggccagaucauuaccuucuuucaagaggugccccacgucauagaagagguuaugaacaucgugcugauugcccucagccuucuggcuaucuugaaggggguauacaauguggcaacaugcggauuauucggucuggucuccuuucuacuccuguguggcagaucuugcucaauuacuuauaaagggguguacgaacuucagacgcuggaguuggacauggccaaccucaauaugaccaugccucugaguuguacaaagaacaauagccaucacuauaucaugguuggaaacgaaacuggccuggagcucaccuuaacaaauaccuccauaaucaaccauaaauucugcaaucugucugaugcgcacaagaaaaaccuuuacgaccaugcuuugaugucgauuaucucaacuuuucaccugagcauuccaaauuucaaccaguaugaggccaugaguugugauuuuaauggugggaagaucuccgugcaguacaaccuaucucacacauaugcaggagacgccgcugaucauugcggcaccauagcaaauggcguccuccaaacguucaugaggauggccuggggagggagcuacauugcucuggacuccgguaagggcucaugggauuguaucaugaccaguuaccaguaucuuauuauccagaacacuacaugggaagaccacugccaguuuagccggccgucucccaugggguaccugggauugcucucccaacgcacucgagauaucuauauuucacguagacuguuaggcaccuucacauggacccugagcgacagugaggguaacgaaacgccugggggauacugucucacuagguggaugcuuauagaggccgagcugaaaugcuuuggcaauacagcgguggcaaaguguaacgaaaaacaugaugaggaguucugcgacauguugcggcuauuugauuucaauaagcaggccauccgcagacugaaaaccgaagcucagaugucuauucagcucaucaacaaggccguaaaugcacugauaaacgaccaacuuauuaugaagaaucaccugagggacaucaugggcaucccauauugcaacuacuccaaauauugguacuugaaucacacuauuacagggaagaccagccucccccgguguuggcugguuucgaacggaucuuacuuaaaugaaacgcauuucuccgaugacaucgagcagcaggcugauaacaugauuaccgagcugcuacaaaaagaauauauagaccgccaggguaagacaccucucggccugguggaucuuuuugucuucucaaccaguuuuuacuugaucagcauuuuccugcaccucgugaaaaucccaacucaucgacacaucacagggaagcccugcccuaaaccacauagacugaaucacaugggaauuuguuccugcggccuuuauaagcacccgggugugcccgucagguggaagcgguga

SEQ ID NO: 1643 - RNA, 1473 nt, Artificial Sequence
  derived and/or modified CDS sequence (opt3) from Lassa virus__AIT17666__GPC
augggccagaucgugaccuucuuucaagaggucccccacguuauugaagaggugaugaacauaguacugaucgcccucagccuucuggcuauuuugaaggggaucuacaauguggcaacaugcggauuauucggucuggucuccuuucuacuccuguguggcagaucuugcucaacuacguauaaagggguguacgaacuucagacccuggaguuggacauggccagucucaacaugacaaugccucugagcuguacuaagaauaacucccaucacuauauuaugguuggaaaugaaaccggccuggagcucacauuaaccaacacuucuaucauaaaucauaaauucugcaaccugucggaugcgcacaagaaaaaucuuuacgaccaugcuuugaugucaaucauuagcacauuucaccugaguaucccaaacuucaaucaguaugaggccauguccugugauuuuaacggugggaagauuucugugcaguacaaucuaagccacaccuaugcagucgacgccgcuaaccauugcggaacgaucgcaaauggcgugcuccaaacuuucaugaggauggccuggggcggguccuacauagcucuggauucaggaaaggguaguugggacuguauuaugaccagcuaccaguaucuuaucauucagaacacaacuugggaagaucacugccaguuuucucggccgucccccaucggcuaccugggguugcucucacaacgcacccgagacaucuauauuagccguagacuguuaggaacauucaccuggacgcugagugauucugagggcaacgaaacuccugguggguacugucucacaagguggaugcuuauagaggccgagcugaaaugcuuuggaaauaccgcgguagcaaaguguaacgaaaaacaugacgaggaguucugcgauauguugcggcuauuugacuucaauaagcaggccauccgcagacugaaaacugaagcucagauguccauucagcucaucaacaaggccguuaaugcacugauaaacgaucaacuuauuaugaagaaucaccugagggacaucaugggcaucccauauugcaacuacagcaaauauugguacuugaaucacacagugaccggcaagacgucgcucccccgguguuggcuggucucuaacggguccuacuuaaaugaaacccauuucucagacgauauugagcagcaggcugacaacaugaucacagagcugcuacaaaaagaauauauggaucgccagggaaagacuccucucggucugguggaccuuuuuguguucaguaccagcuuuuacuugauuuccauauuccugcaccucgucaaaaucccaacacaucgacacauuacuggcaagcccugcccuaaaccacauagacugaaucacauggggaucuguucuugcggacuuuauaagcacccgggcguucccgugaaguggaaaagguga

SEQ ID NO: 1644 - RNA, 1473 nt, Artificial Sequence
  derived and/or modified CDS sequence (opt3) from Lassa virus__AIT17670__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaauaccgcgguggcaaaguguaacgaaaaacaugacgaggaguucugcgauauguugcggcuauuugacuucaauaagcaggccauucgcagacugaaagcugaagcccagauguccauccagcucauaaacaaggcaguaaaugcucugauuaacgaucaacuuaucaugaagaaucaccugagggacaucaugggcauuccauauugcaacuacagcaaauauugguacuugaaucacacuguuacaggccggaccucgcucccccgcuguuggcuggugucuaacggguccuacuuaaaugaaacgcauuucucagacgauaucgagcagcaggccgacaacaugauuaccgagcugcuacaaaaggaauauauagaucgacagggaaaaacaccucucggucuggucgaccuuuuuguguucaguacuagcuuuuacuugaucuccauuuuccugcaccucgugaagaucccaacccauagacacaucauuggcaaacccugcccuaagccacauaggcugaaucacauggggauauguucuugcggacuuuauaaacacccgggcguccccguuaaguggaagcgguga

SEQ ID NO: 1645 - RNA, 1473 nt, Artificial Sequence
  derived and/or modified CDS sequence (opt3) from Lassa virus__AIT17674__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacaugacaaaccucaauaugacuaugccucugaguuguaccaagaacaauagccaucacuauaucauggugggaaacgaaacaggccuggagcucaccuuaacuaauacauccauaaucaaccauaaauucugcaaucugucugaugcccacaagaaaaaccuuuacaaucaugcguugaugucgauuaucucaaccuuucaccugagcauuccaaacuucaaucaguaugaggcuaugaguugugacuuuaacggugggaagaucuccguucaguacaaucuaucucacagcuaugccguggaugcagccaaccauugcggaacgauagcuaacggcguccuccaaacuuucaugaggauggcauggggcggguccuacauugcccuggacucaggaaaggguaauugggauuguaucaugaccaguuaccaguaucuuauuauccagaacacaacuugggaagaccacugccaguuuagccggccgucucccaucggcuaccugggguugcucucccaacgcacccgagauauuuauauaucacguagacuguuaggaacauucaccuggacgcugagcgacagugagggcaaugaaacuccugguggguacugucucacaagguggaugcuuaucgaggcugagcugaaaugcuuuggaaacaccgccguggcgaaguguaaugaaaaacaugaugaggaguucugcgacauguugcggcuauuugauuucaacaagcaggcaauucgcagacugaaaacugaagcccaggcuaauauccagcucauaaacaaggccguaaaugcacugauuaacgaccaacuuaucaugaagaaucaccugagggauaucaugggcauuccauauugcaacuacucuaaauauugguacuugaaucacacaguuaccggcaagacgucccucccccgguguuggcuggugagcaacgggucguacuuaaaugaaacccauuucucugacgacaucgagcagcaggcugauaacaugauuacagagcugcuacaaaaagaauauauggaccgccagggaaagacuccucucggucuggucgaucuuuuuguguucuccaccucauuuuacuugauaaguaucuuccugcaccucgugaaaauuccaacacaucgacacgucaucggcaagcccugcccuaaaccacauagacugaaccacauggggaucuguagcugcggacuuuauaagcacccgggcguucccgugaaguggaaaagguga

SEQ ID NO: 1646 - RNA, 1473 nt, Artificial Sequence
  derived and/or modified CDS sequence (opt3) from Lassa virus__AIT17678__GPC
augggccagaucauuaccuucuuucaagaggugccccacgucauagaagagguuaugaacaucgugcugauuacacucagccuucuggccaucuugaaggggauuuacaauaucgcuacuugcggauuauucggucugguauccuuucuacuccuguguggcagaucuugcucaacgaccuauaaagggguguacgaacuucagacacuggaguuggacaugaccagucucaacaugacuaugccucugagcuguacaaagaauaacucccaucacuauauaauggucggaaaugaaaccggccuggagcucacuuuaacaaacaccucuaucauuaaucauaaauucugcaaccugucggaugcacacaagaaaaaucuuuacgaccaugccuugaugucaaucauuagcacguuucaccugaguaucccaaacuucaaucaguaugaggcgauguccugugauuuuaacggugggaagauaucugugcaguacaaucuaagccacacuuaugcuguugacgccgcaaaccauugcggaaccauugccaauggcgugcuccaaacauucaugaggauggcuuggggcggguccuacaucgcacuggauucaggaaaggguaguugggacuguauuaugacuagcuaccaguaucuuaucauccagaacaccacaugggaagaucacugccaguuuucucggccgucccccauuggcuaccugggguugcucucacaacgcacccgagacauauauaucagccguagacuguuaggaacguucacuuggacacugagugauucugagggcaacgaaaccccugguggguacugucucacuagguggaugcuuauugaggccgagcugaaaugcuuuggaaauacagcugucgccaaguguaacgaaaaacaugacgaggaguucugcgauauguugcggcuauuugacuucaauaagcaggcgauccgcagacugaaaaccgaagcacagauguccauacagcucauuaacaaggccgugaaugcucugaucaacgaucaacuuaucaugaagaaucaccugagggacauuaugggcaucccauauugcaacuacagcaaauauugguacuugaaucacacgguaaccggcaagacaucgcucccccgguguuggcugguuucuaacggguccuacuuaaaugaaacucauuucucagacgauauugagcagcaggccgacaacaugauaaccgagcugcuacaaaaagaauauaucgaucgccagggaaagacaccucucggucugguggaccuuuuugucuucaguacuagcuuuuacuugauuuccaucuuccugcaccucgugaaaaucccaacccaucgacacauuauaggcaagcccugcccuaaaccacauagacugaaucacauggggaucuguucuugcggacuuuauaagcacccgggcauucccgugaaguggaaaagguga

SEQ ID NO: 1647 - RNA, 1473 nt, Artificial Sequence
  derived and/or modified CDS sequence (opt3) from Lassa virus__AIT17686__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucacggaagggaaguugggacuguaucaugaccagcuaccaguaucuuauuauccagaacacaacuugggaagaucacugccaguuuucucgcccgucccccaucgguuaccugggcuugcucucacaacgaacccgugacauuuauauaagcagaaggcuguuagggacauucaccuggacgcugagugauucugagggaaacgaaacuccuggcgguuacugucucacacgguggaugcuuaucgaggccgagcugaaaugcuuugggaauaccgcgguggcaaaguguaacgaaaaacaugacgaggaguucugcgauauguugcgccuauuugacuucaauaagcaggccauuagaaggcugaaaacugaagcucagauguccauccagcucauaaacaaggccguaaaugcacugauuaacgaucaacuuaucaugaagaaucaucugcgggacaucaugggcauuccauauugcaacuacagcaaauauugguacuugaaucacacaguuaccggaaagacgucgcucccccgcuguuggcuggugucuaacggcuccuacuuaaaugaaacccacuucucagacgauaucgagcagcaggcugacaacaugauuacagagcugcuacaaaaagaauauauggaucgacaggggaagacuccucucggacuggucgaccuuuuuguguucaguaccagcuuuuacuugauauccaucuuccugcaccucauuaaaaucccaacacauagacacgugaucgguaagcccugcccuaaaccacauaggcugaaucacaugggcauuuguucuugcgggcuuuauaagcacccgggaguccccguuaaguggaaacgguga

SEQ ID NO: 1648 - RNA, 1473 nt, Artificial Sequence
  derived and/or modified CDS sequence (opt3) from Lassa virus__AIT17690__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccguggacgcugcaucccauugcggaaccgucgccaacggcgugcuccaaacguucaugaggauggcuuggggcgggucauacauagcccuggauaguggaaaggguagcugggacuguauuaugacuucuuaccaguaucuuaucauucagaauaccacaugggaagaucacugccaguuuucccggccgucacccaucggcuaccugggguugcucagccaacgcacucgagacaucuauauuagucguagacuguuaggaaccuucacauggacccugucugauuccgagggcaacgaaacgccugguggguacugucucacuagguggaugcuuauagaggcggagcugaaaugcuuuggaaacacagcaguagccaaguguaaugaaaaacaugacgaggaguucugcgauauguugcggcuauuugacuucaacaagcaggcuauccgcagacugaaaaccgaagcccagaugagcauucagcucaucaauaaggcaguuaacgcucugauaaaugaucaacuuauuaugaagaaccaccugagggacaucaugggcaucccauauugcaauuacucgaaauauugguacuugaaccacacugugacaggccggaccucucucccccgcuguuggcuggucuccaaugggucauacuuaaacgaaacgcauuucagugacgauauugagcagcaggccgacaauaugaucaccgagcugcuacaaaaggaauauauggaucgacagggaaaaacaccucucggucugguggaccuuuuuguguucagcacuuccuuuuacuugauuucuauauuccugcaccucgucaagaucccaacccauagacacguuauuggcaaacccugcccuaagccacauaggcugaaccacauggggaucuguagcugcggacuuuauaaacacccgggcgugcccguaaaguggaagcgguga

SEQ ID NO: 1649 - RNA, 1473 nt, Artificial Sequence
  derived and/or modified CDS sequence (opt3) from Lassa virus__AIT17694__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuaucuauaaaggggucuacgaacuucagacgcuggaguuggacauggccagucucaacaugaccaugccucugagcuguacaaagaauaacucccaucacuauauaauggugggaaaugaaacuggccuggagcucaccuuaacaaacaccucuaucauuaaucauaaauucugcaaccugucggaugcgcacaagaaaaaucuuuacgaccaugcuuugaugucaaucauuagcacuuuucaccugaguaucccaaacuucaaucaguaugaggccauguccugugauuuuaacggugggaagauaucuguucaguacaaucuaagccacacauaugcaguggacgccgcuaaccauugcggaaccauugcaaauggcguccuccaaacguucaugaggauggccuggggcggguccuacaucgcucuggauucaggaaaggguaguugggacuguauuaugacuagcuaccaguaucuuaucauccagaacaccacaugggaagaucacugccaguuuucucggccgucccccauuggcuaccugggguugcucucacaacgcacucgagacauauauaucagccguagacuguuaggaaccuucacauggacccugagugauucugagggcaacgaaacgccugguggguacugucucacuagguggaugcuuauugaggccgagcugaaaugcuuuggaaauacagcgguggcaaaguguaacgaaaaacaugacgaggaguucugcgauauguugcggcuauuugacuucaauaagcaggccauccgcagacugaaaaccgaagcucagauguccauacagcucauuaacaaggccguaaaugcacugaucaacgaucaacuuaucaugaagaaucaccugagggacauuaugggcaucccauauugcaacuacagcaaauauugguacuugaaucacacuguuacaggcaagaccucgcucccccgguguuggcuggugucuaacggguccuacuuaaaugaaacgcauuucucagacgauauugagcagcaggcugacaacaugauaaccgagcugcuacaaaaagaauauaucgaucgccagggaaagacaccucucggucuggucgaccuuuuuguguucaguacuagcuuuuacuugauuuccaucuuccugcaccucgugaaaaucccaacccaucgacacgucguuggcaagcccugcccuaaaccacauagacugaaucacauggggauuuguucuugcggacuuuauaagcacccgggcgugcccguaaaguggaaaagguga

SEQ ID NO: 1650 - RNA, 1473 nt, Artificial Sequence
  derived and/or modified CDS sequence (opt3) from Lassa virus__AIT17712__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaagggugccugggacuguaucaugaccaguuaccaguaucuuauuauccagaacacaacuugggaagaucacugccaguuuagccggccgucucccaucggcuaccugggguugcucucccaacgcacccgagacauuuauauaucacguagacuguuaggaacauucaccuggacgcugagcgauagugagggcaacgaaacuccugguggguacugucucacaagguggaugcuuaucgaggcggagcugaaaugcuuuggaaauaccgcaguggccaaguguaacgaaaaacaugacgaggaguucugcgauauguugcggcuauuugacuucaauaagcaggcuauuaugcgccugaaaacugaagcccagaugucuauccagcucauaaacaaggcaguaaaugcucugauuaacgaucaacuuaucaugaagaaucaccugagagacaucaugggcauuccauauugcaacuacuccaaauauugguacuugaaucacacaguuaccggcaagacgagccuccccagguguuggcuggugucgaacgggucuuacuuaaaugaaacccauuucuccgacgauaucgagcagcaggccgacaacaugauuacagagaugcugcaaaaagaauauauagaucggcagggaaagacuccucuaggucucgucgaccuguuuguguucucaaccaguuuuuaccuuaucagcauuuucuugcaccuggugaaaaucccaacacaucgccacgucaucggcaagcccugcccuaaaccacaucgacucaaucacauggggauuuguuccugcggacuguauaagcacccgggcguucccgugagauggaagagguga

SEQ ID NO: 1651 - RNA, 1473 nt, Artificial Sequence
  derived and/or modified CDS sequence (opt3) from Lassa virus__AIT17718__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucagggugggaaaugaaaccggccuggagcucacauuaaccaacgcgucuauaaucaaucauaaauucugcaaccugucggaugcucacaagaaaaaucuuuacgaccaugccuugaugucaauuaucagcacuuuucaccugaguauuccaaacuucaaucaguaugaggcaauguccugugauuuuaacggugggaagaucucuguucaguacaaucuaagccacgccuaugcuauagacgcagccaaccauugcggaacaguggcuaauggcguccuccaaaccuucaugcggauggccuggggcggguccuacauugcgcuggauucaggacgcgguaacugggacuguaucaugacgaguuaccaguaucuuauuauccagaacacuaccugggaagaucacugccaguuuagccgaccgucucccaucggcuaccugggguugcucucccaacguacaagagacauuuauauaucaaggcggcuguuaggaacuuucaccuggacacugagcgauagugagggcaaugaaaccccugguggguacugucucacgcgcuggaugcuuaucgaggcagagcugaagugcuuuggaaacacugccguggcuaaauguaaugaaaagcaugacgaggaguucugcgauauguugagacuauuugacuucaacaaacaggccauuaggcggcugaagacagaagcacagaugucuauccagcucauaaauaaagcuguaaacgcccugauuaaugaucaacuuaucaugaagaaccaucugcgcgacaucaugggcauuccauauugcaauuacuccaaguauugguacuugaaccacaccguuacuggcaaaacaagccucccccgauguuggcuggugucgaaugggucuuacuuaaacgaaacccacuucuccgacgauaucgagcagcaggcggacaauaugauuacggagcugcuacaaaaggaauauauggauagacagggaaaaaccccucucggucuggucgaccuuuuuguguucucaacaaguuuuuacuugauaagcaucuuccugcaccucgugaagauuccaacucauaggcacgucaucggcaaacccugcccuaagccacaucggcugaaccacauggggaucuguuccugcggauuuuauaaacacccgggcguucccgugaaguggaagcguuga

SEQ ID NO: 1652 - RNA, 1473 nt, Artificial Sequence
  derived and/or modified CDS sequence (opt3) from Lassa virus__AIT17724__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccaaccucaauaugacaaugccucugaguuguacuaagaacaauagccaucacuauaucauggugggaaacgaaaccggccuggagcucacauuaaccaauacuuccauaaucaaccauaaauucugcaaucugucugaugcgcacaagaaaaaccuuuacgaccaugcuuugaugucgauuaucucaacauuucaccugagcauuccaaauuucaaccaguaugaggccaugaguugugauuuuaauggugggaagaucuccguucaguacaaccuaucucacaccuaugcaguggacgccgcuaaucauugcggaacggucgcaaacggcgugcuccaaacuuucaugaggauggccuggggcgggagcuacauagcucuggauuccggaaaggguucaugggacuguauuaugaccaguuaccaguaucuuaucauucagaacacaacuugggaagaucacugccaguuuagccggccgucucccaucggcuaccugggguugcucucccaacgcacccgagacaucuauauuucacguagacuguuaggaacauucaccuggacgcugagcgauagugagggcaaugaaacuccugguggguacugucucacaagguggaugcuuauagaggccgagcugaaaugcuuuggaaacaccgcgguagcaaaguguaaugaaaaacaugacgaggaguucugcgauauguugcggcuauuugacuucaacaagcaggccauccgcagacugaaaacugaagcucagaugucuauucagcucaucaauaaggccguuaacgcacugauaaaugaucaacuuauuaugaagaaccaccugagggacaucaugggcaucccauauugcaauuacuccaaauauugguacuugaaccacacagugaccggcaagacgagccucccccgguguuggcuggucucgaaugggucuuacuuaaacgaaacccauuucuccgacgauauugagcagcaggcugacaauaugaucacagagcugcuacaaaaagaauauauggaucgccagggaaagacuccucucggucugguggaccuuuuuguguucucaaccaguuuuuacuugauuagcauauuccugcaccucgucaaaaucccaacacaucgacacauuaugggcaagcccugcccuaaaccacauagacugaaccacauggggaucuguuccugcggacuuuauaagcacccgggcguucccgugaaguggaaaagguga

SEQ ID NO: 1653 - RNA, 1473 nt, Artificial Sequence
  derived and/or modified CDS sequence (opt3) from Lassa virus__AIT17728__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacaugggaagucucaacaugacaaugccucugagcuguacuaagaauaacucccaucacuauaucauggugggcaaugaaaccggucuggagcucacauuaaccaacacuucuauaaucaaucauaaauucugcaaccugucggaugcccacaagaaaaaucuuuacgaccaugcguugaugucaauuaucagcacauuucaccugaguauuccaaacuucaaucaguaugaggcuauguccugugauuuuaacgggggaaagaucucuguucaguacaaucuaagccacaccuaugccguggacgcagccaaccauugcggcacgauagcuaauggcguccuccaaacuuucaugaggauggcauggggaggguccuacauugcccuggauucagguaagggcaguugggacuguaucaugaccagcuaccaguaucuuauuauccagaacacaacuugggaagaucacugccaguuuucucggccgucccccaucggguaccugggauugcucucacaacgcacccgagacauuuauauaagccguagacuguuaggcacauucaccuggacgcugagugauucugaggguaacgaaacuccugggggauacugucucacaagguggaugcuuaucgaggcugagcugaaaugcuuuggcaauaccgccguggcgaaguguaacgaaaaacaugacgaggaguucugcgauauguugcggcuauuugacuucaauaagcaggcaauucgcagacugaaaacugaagcccagauguccauccagcucauaaacaaggcuguaaaugcccugauuaacgaucaacuuaucaugaagaaucaccugagggacaucaugggcauuccauauugcaacuacagcaaauauugguacuugaaucacacaguuaccgggaagacgucgcucccccgguguuggcuggugucuaacggauccuacuuaaaugaaacccauuucucagacgauaucgagcagcaggcagacaacaugauuacagagcugcuacaaaaagaauauauggaucgccaggguaagacuccucucggccuggucgaccuuuuuguguucaguaccagcuuuuacuugauauccaucuuccugcaccucgugaaaauuccaacacaucgacacgucaucgggaagcccugcccuaaaccacauagacugaaucacaugggaaucuguucuugcggccuuuauaagcacccggguguucccgugaaguggaaaagguga

SEQ ID NO: 1654 - RNA, 1473 nt, Artificial Sequence
  derived and/or modified CDS sequence (opt3) from Lassa virus__AIT17732__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaauaccgcgguggcaaaguguaacgaaaaacaugacgaggaguucugcgauauguugcggcuauuugacuucaauaagcaggccauucgcagacugaaaacugaagcucagauguccauccagcucauaaacaaggccguaaaugcacugauuaacgaucaacuuaucaugaagaaucaccugagggacaucaugggcauuccauauugcaacuacagcaaauauugguacuugaaucacacaguuaccggcaagacgucgcucccccgguguuggcuggugucuaacggguccuacuuaaaugaaacccauuucucagacgauaucgagcagcaggcugacaacaugauuacagagcugcuacaaaaagaauauauagaucgccagggaaagacuccucucggucuggucgaccuuuuuguguucaguaccagcuuuuacuugaucuccauuuuccugcaccucgugaaaaucccaacacaucgacacaucgucggcaagcccugcccuaaaccacauagacugaaucacauggggauuuguucuugcggacuuuauaagcacccgggcguucccgugaaguggaaaagguga

SEQ ID NO: 1655 - RNA, 1473 nt, Artificial Sequence
  derived and/or modified CDS sequence (opt3) from Lassa virus__AIT17736__GPC
augggccagaucgugaccuucuuucaagaggucccccacguuauugaagaggugaugaacauaguacugaucgcccucagccuucuggcuauuuugaaggggaucuacaauguggcaacaugcggauuauucggucuggucuccuuucuacuccuguguggcagaucuugcucaacuacguauaaagggguguacgaacuucagacccuggaguuggacauggccagucucaacaugacaaugccucugagcuguacuaagaauaacucccaucacuauauuaugguuggaaaugaaaccggccuggagcucacauuaaccaacacuucuaucauaaaucauaaauucugcaaccugucggaugcgcacaagaaagaccuuuacgaucaugcuuugaugucaaucauuagcacauuucaccugaguaucccaaauuucaaccaguaugaggccauguccugugacuuuaauggugggaagauuucugugcaguacaaccuaagccacaccuaugcagucgaugccgcuaaucauugcggaacgaucgcaaacggcgugcuccaaacuuucaugaggauggccuggggcggguccuacauagcucuggacucaggaaaggguaguugggauuguauuaugaccagcuaccaguaucuuaucauucagaauacaacuugggaagaccacugccaguuuucucggccgucccccaucggcuaccugggguugcucucacaacgcacccgagauaucuauauuagccguagacuguuaggaacauucaccuggacgcugagugacucugagggcaacgaaacuccugguggguacugucucacaagguggaugcuuauagaggccgagcugaaaugcuuuggaaacaccgcgguagcaaaguguaaugaaaaacaugaugaggaguucugcgacauguugcggcuauuugauuucaacaagcaggccaucaugcgccugaaaacugaagcucagauguccauucagcucaucaauaaggccguuaacgcacugauaaaugaccaacuuauuaugaagaaccaccugagagacaucaugggcaucccauauugcaauuacagcaaauauugguacuugaaccacacagugaccggcaagacgucgcuccccagguguuggcuggucucuaauggguccuacuuaaacgaaacccgguucucagaugacauugagcagcaggcugauaauaugaucacagagaugcugcaaaaagaauaucuagaccgccagggaaagacuccucucggucugguggaucuuuuuguguucaguaccagcuuuuacuugauuuccauauuccugcaucucgucaaaaucccaacacaccgacauauuaucggcaagcccugcccuaaaccacacagacugaaccauauggggaucuguucuugcggacuuuauaagcacccgggcguucccgugaaguggaaaagguga

SEQ ID NO: 1656 - RNA, 1473 nt, Artificial Sequence
  derived and/or modified CDS sequence (opt3) from Lassa virus__AIT17744__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugauguccuuucuacuccuguguggcagaucuugcucaacuacguauaaagggguguacgaacuucagacccuggaguuggacauggccaaccucaauaugacaaugccucugaguuguacuaagaacaauagccaucacuauaucauggucggaaacgaaaccggccuggagcucacauuaaccaauacuuccauaaucaaccauaaauucugcaaucugucugaugcgcacaagaaaaaccuuuacgaccaugcuuugaugucgauuaucucaacauuucaccugagcauuccaaauuucaaccaguaugaggccaugaguugugauuuuaauggugggaagaucuccgugcaguacaaccuaucucacgcauaugccguugacgcugcaaaucauugcggaaccauagccaacggcgugcuccaaacguucaugaggauggcuuggggcgggagcuacauugcccuggauuccggaaaggguucaugggacuguaucaugacaaguuaccaguaucuuauuauccagaacaccagcugggaagaucacugccaguuuucucggccgucccccaucggcuaccugggguugcucucacaacgcacacgagacauuuauauaagccguagacuguuaggaacuuucaccuggacacugagugauucugagggcaaugaaaccccugguggguacugucucacgagguggaugcuuaucgaggcggagcugaaaugcuuuggaaacacugcagucgccaaguguaaugaaaaacaugacgaggaguucugcgauauguugcggcuauuugacuucaacaagcaggcuauucgcagacugaaaacagaagcccagauguccauccagcucauaaauaaggcagugaacgcucugauuaaugaucaacuuaucaugaagaaccaccugagggacaucaugggcauuccauauugcaauuacagcaaauauugguacuugaaccacaccguaacuggcaagacaucgcucccccgguguuggcugguuucuaauggguccuacuuaaacgaaacccauuucucagacgauaucgagcagcaggccgacaauaugauuacggagcugcuacaaaaagaauauauagaucgccagggaaagaccccucucggucugguggaccuuuuugucuucaguacuagcuuuuacuugaucuccauuuuccugcaccucgugaaaaucccaacucaucgacacgugaucggcaagcccugcccuaaaccacauagacugaaccacauggggauuuguucuugcggacuuuauaagcacccgggcguccccguuaaguggaaaagguga

SEQ ID NO: 1657 - RNA, 1473 nt, Artificial Sequence
  derived and/or modified CDS sequence (opt3) from Lassa virus__AIT17752__GPC
augggccagaucauuaccuucuuucacgaggugccccaugucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucaaacccuggaguuggacauggccagucucaacaugacaaugccucugagcuguacuaagaauaacucccaccauuauaucauggugggaaaugaaaccggccuggagcucacauuaaccaacacuucuauaaucaaucacaaauucugcaaccugucggaugcgcauaagaaaaaucuuuacgaccacgcuuugaugucaauuaucagcacauuucaccugaguauuccaaacuucaaucaguaugaggccauguccugugauuuuaacggugggaagaucucuguucaguacaaucuaagccauaccuaugcaauagacgccgcuaaccacugcggaacgauugcaaauggcgugcuccagacuuucaugaggauggccuggggcggguccuacaucgcucuggauucaggacgggguaguugggacuguauuaugaccagcuaccaauaucuuaucauccagaacacaacuugggaagaucauugccaguuuucucgcccgucccccauuggcuaccugggguugcucucacagcgaacccgugacauauauaucagcagaaggcuguuaggaacauucaccuggacgcugagugauucugagggcaacgaaacuccugguggguacugucucacacgguggaugcuuauugaggccgagcugaagugcuuuggaaauaccgcggucgcaaaauguaacgaaaagcacgacgaggaguucugcgauauguugcgccuauuugacuucaauaaacaagccaucagaaggcugaagacugaagcucagauguccauacagcucauuaacaaagccgugaaugcacugaucaacgaucagcuuaucaugaagaaucaucugcgggacauuaugggcaucccauauugcaacuacagcaaguauugguacuugaaucacacaguaaccggcaaaacgucgcucccccgcuguuggcugguuucuaacggguccuacuuaaaugaaacccacuucucagacgauauugagcaacaggcugacaacaugauaacagagcugcuacagaaggaauauaucgaucgacaaggaaaaacuccucucggucugguggaccuuuuugucuucaguaccagcuuuuacuugauuuccaucuuccugcaucucgugaagaucccaacacacagacaugugauuggcaaacccugcccuaagccacacaggcugaaucacauggggauauguucuugcggacuuuauaaacauccgggcguccccguuaaguggaagcgguga

SEQ ID NO: 1658 - RNA, 1473 nt, Artificial Sequence
  derived and/or modified CDS sequence (opt3) from Lassa virus__AIT17756__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaaucacuuauaaaggggucuacgaacuucagacgcuggaguuggacauggccagucucaacaugaccaugccucugagcuguacaaagaauaacucccaucacuauauaauggugggaaaugaaacuggccuggagcucaccuuaacaaacaccucuaucauuaaucauaaauucugcaaccugucggaugcgcacaagaaaaaucuuuacgaccaugcuuugaugucaaucauuagcacuuuucaccugaguaucccaaacuucaaucaguaugaggccauguccugugauuuuaacggugggaagauaucuguucaguacaaucuaagccacacauaugcaguggacgccgcuaaccauugcggaaccauugcaaauggcguccuccaaacguucaugaggauggccuggggcggguccuacaucgcucuggauucaggacgggguaguugggacuguauuaugacuagcuaccaguaucuuaucauccagaacaccacaugggaagaucacugccaguuuucucgcccgucccccauuggcuaccugggguugcucucacaacgaacucgugacauauauaucagcagaaggcuguuaggaaccuucacauggacccugagugauucugagggcaacgaaacgccugguggguacugucucacucgguggaugcuuauugaggccgagcugaagugcuuuggaaauacagcgguggcaaaauguaacgaaaagcaugacgaggaguucugcgauauguugcgccuauuugacuucaauaaacaggccaucagaaggcugaaggcugaagcccagauguccauacagcucauuaacaaagcaguaaaugcucugaucaacgaucaacuuaucaugaagaaucaucugcgggacauuaugggcaucccauauugcaacuacagcaaguauugguacuugaaucacaccguuacuggccgcacaucgcucccccgauguuggcuggugucuaacggguccuacuuaaaugaaacccacuucucagacgauauugagcagcaggccgacaacaugauaacggagcugcuacaaaaagaauauaucgauagacagggaaagaccccucucggucuggucgaccuuuuuguguucaguacuagcuuuuacuugauuuccaucuuccugcaccucgugaaaaucccaacacauaggcacauuauaggcaagcccugcccuaaaccacaucggcugaaucacauggggaucuguucuugcggacuuuauaagcacccgggcguccccguuaaauggaagcguuga

SEQ ID NO: 1659 - RNA, 1473 nt, Artificial Sequence
  derived and/or modified CDS sequence (opt3) from Lassa virus__AIT17758__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguugaacauggccagucucaauaugacaaugccucugagcuguacuaagaacaauucccaucacuauaucauggugggaaacgaaaccggccuggagcucacauuaaccaauacuucuauaaucaaccauaaauucugcaaucugucggacgcgcacaagaggaaccuuuacgaucaugcuuugaugucaauuaucagcacauuucaccugaguauuccaaauuucaaccaguaugaggccauguccugugacuuuaauggugggaaaaucucuguucaguacaaccuaagccacaccuaugcaguggaugccgcuaagcauugcggaacgauagcaaauggcguccuccaaacuuucaugcggauggccuggggcggguccuacauugcucuggacucaggaaaggguaguugggauuguaucaugaccagcuaccaguaucuuauuauccagaacacaacuugggaagaccacugcgaguuuucucgcccgucccccaucggcuaccugggguugcucucacagcgaacccgugauauuuauauaagcagaaggcuguuaggaacauucaccuggacgcugagugacucugaaggcaacgagacuccugguggguacugucucacacgguggaugcuuaucgaggccgaacugaaaugcuuuggaaauaccgcgguggcaaaguguaacgagaaacaugaugaagaguucugcgacauguugcgccuauuugauuucaauaagcaagccauuagaaggcugaaagcugaagcccagauguccauccagcucauaaacaaggcaguaaaugcucugauuaacgaccagcuuaucaugaagaaucaucugcgggauaucaugggcauuccauauugcaacuacagcaaauauugguacuugaaucacacuguuacaggcaagaccucgcucccccgcuguuggcuggugucuaacggguccuacuuaaaugagacgcacuucucagacgacaucgagcaacaggccgauaacaugauuaccgaacugcuacagaaagaguauauagaccgacaaggaaagacaccucucggucuggucgaucuuuuuguguucaguacuagcuuuuacuugaucuccauuuuccugcaccucgugaaaaucccaacccauagacacgucaucggcaagcccugcccuaaaccacauaggcugaaucacauggggauuuguucuugcggacuuuauaagcacccgggcguucccgugaaguggaaacgguga

SEQ ID NO: 1660 - RNA, 1473 nt, Artificial Sequence
  derived and/or modified CDS sequence (opt3) from Lassa virus__AIT17762__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucucgcauaaauucugcaaucugucagaugcgcacaagaaaaaccuuuacgaccaugcuuugaugagcauuaucaguacauuucaccuguccauuccaaauuucaaccaguaugaggccaugucuugugauuuuaauggugggaagaucagcguucaguacaaccuaucccacaccuaugcaguggacgccgcuaaucauugcggaacgauagcaaacggcguccuccaaacuuucaugaggauggccuggggcgggucauacauugcucuggauaguggaaaggguagcugggacuguaucaugaccucuuaccaguaucuuauuauccagaauacaacuugggaagaucacugccaguuuucccggccgucacccaucggcuaccugggguugcucagccaacgcacccgagacauuuauauaagucguagacuguuaggaacauucaccuggacgcugucugauuccgagggcaacgaagccccugguggguacugucucacuagguggaugcuuaucgaggcggagcugaaaugcuuuggaaacacagcaguggccaaguguaaugaaaaacaugacgaggaguucugcgauauguugcggcuauuugacuucaacaagcaggcuauucgcagacugaaaaccgaagcccagaugagcauccagcucauaaauaaggcaguaaacgcucugauuaaugaucaacuuaucaugaagaaccaccugagggacaucaugggcauuccauauugcaauuacucgcgguauugguacuugaaccacacuguuacaggcaaaaccucucucccccgcuguuggcugguguccaaugggucauacuuaaacgaaacgcauuucagugacgauaucgagcagcaggccgacaauaugauuaccgagcugcuacaaaaggaauauauggaucgacagggaaaaacaccucucggucuggucgaccuuuuuguguucagcacuuccuuuuacuugauaucuaucuuccugcaccucgugaagauuccaacccauagacacgucaucggcaaacccugcccuaagccacauaggcugaaccacauggggaucuguagcugcggacuuuauaaacacccgggcguucccgugaaguggaagcgguga

SEQ ID NO: 1661 - RNA, 1473 nt, Artificial Sequence
  derived and/or modified CDS sequence (opt3) from Lassa virus__AIT17770__GPC
augggccagaucgugaccuucuuucaagaggucccccacguuauugaagaggugaugaacauaguacugaucgcccucagccuucuggcuauuuugaaggggaucuacaauguggcaacaugcggauuauucggucuggucuccuuucuacuccuguguggcagaucuugcucaacuacguauaaagggguguacgaacuucaggcccuggaguuggacaugaguagccucaacaugaccaugccucuguccuguacaaagaauaacucucaucacuauauuaugguuggaaaugaaacuggccuggagcucaccuuaacaaacaccucgaucauacaucacaaauucugcaaucugucagaugcgcauaagaaagaccuuuacgaucacgcuuugaugagcaucauuaguacuuuucaccuguccaucccaaacuucaaucaguaugaggccaugucuugugacuuuaacggugggaagauuagcgugcaguacaaucuaucccauacauaugcagucgaugccgcuaaccacugcggaaccaucgcaaauggcgugcuccaaacguucaugaggauggccuggggcgggucauacauagcucuggacaguggaaaggguggcugggauuguauuaugacuagcuaccaguuucuuaucauucagaacaccacaugggaagaccauugccaguucucucggccgucccccaucggguaucugggauugcucucacaacgcacucgagauaucuacauuagccguagacuguuaggcaccuuuacauggacccugagugacucugaggguaaugaaacgccugggggauauugucucacuagguggaugcuuauagaggccgagcugaaaugcuucggcaacacagcgguagcaaaguguaacgaaaaacacgaugaggaauuuugcgacauguugcggcuauucgauuucaauaagcaggccaucaaacgccugaagaccgaggcucagauguccauucaccucaucaacaaggccguuaaugcacugauaaacgaccagcuuauuaugaaaaaucaucugagagacaucaugggcaucccauacugcaacuauagcaaguacugguauuugaaucacacugugacagggaaaaccucgcuccccagguguuggcuggucucuaacggauccuacuuaaaugaaacgcauuuuucagaugacauugagcaacaggcugauaacaugaucaccgagcugcuacagaaggaauacauugaccggcaagguaaaacaccucucggccugguggaucuuuucguguuuaguacuagcuucuauuugauauccaucuuucugcaccucgucaagauuccaacccaucgccacguuaucgggaaacccugcccuaagccacaccgacugaaucauaugggaaucuguucuugcggccuuuacaagcacccgggugugcccguaagauggaaaagguga

SEQ ID NO: 1662 - RNA, 1473 nt, Artificial Sequence
  derived and/or modified CDS sequence (opt3) from Lassa virus__AIT17778__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccaaccucaauaugacaaugccucugaguuguacuaagaacaauagccaucacuauaucauggugggaaacgaaaccggccuggagcucacauuaaccaauacuuccauaaucaaccauaaauucugcaaucugucugaugcgcacaagaaaaaccuuuacgaccaugcuuugaugucgauuaucucaacauuucaccugagcauuccaaauuucaaccaguaugaggccaugaguugugauuuuaauggugggaagaucuccguucaguacaaccuaucucacaccuaugcaagggacgccgcuaaucauugcggaacgauagcaaacggcgugcuccaaacuuucaugcggauggccuggggcgggagcuacauugcucuggauuccggaaaggguucaugggacuguaucaugaccaguuaccaguaucuuauuauccagaacacaacuugggaagaucacugccaguuuagccgcccgucucccaucggcuaccugggguugcucucccaacgaacccgugacauuuauauaucaagaaggcuguuaggaacauucaccuggacgcugagcgauagugagggcaaugaaacuccugguggguacugucucacacgguggaugcuuaucgaggccgagcugaaaugcuuuggaaacaccgcggucgcaaaguguaaugaaaaacaugacgaggaguucugcgauauguugcgccuauuugacuucaacaagcaggccauuagaaggcugaaaacugaagcucagaugaauauccagcucauaaacaaggccgugaaugcacugauuaacgaucaacuuaucaugaagaaucaucugcgggacaucaugggcauuccauauugcaacuacucuaaauauugguacuugaaucacacaguaaccggcaagacgucccucccccgcuguuggcugguuagcaacgggucguacuuaaaugaaacccacuucucugacgauaucgagcagcaggcugacaacaugauuacagagcugcuacaaaaagaauauauggaucgacagggaaagacuccucucggucugguggaccuuuuugucuucuccaccucauuuuacuugauaaguaucuuccugcaccucgugaaaauuccaacacauagacacgugaucggcaagcccugcccuaaaccacauaggcugaaucacauggggaucuguagcugcggacuuuauaagcacccgggcguccccguuaaguggaaacgguga

SEQ ID NO: 1663 - RNA, 1473 nt, Artificial Sequence
  derived and/or modified CDS sequence (opt3) from Lassa virus__AIT17782__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaauaccgcgguggcaaaguguaacgaaaaacaugacgaggaguucugcgauauguugcggcuauuugacuucaauaagcaggccauuaaacgccugaagacugaagcucagauguccauccagcucauaaacaaggccguaaaugcacugauuaacgaucaacuuaucaugaaaaaucaccugagagacaucaugggcauuccauauugcaacuacagcaaguauugguacuugaaucacacaguuaccggcaaaacgucgcuccccagguguuggcuggugucuaacggguccuacuuaaaugaaacccauuucucagacgauaucgagcagcaggcugacaacaugauuacagagcugcuacaaaaggaauauauagaucggcagggaaaaacuccucucggucuggucgaccuuuuuguguucaguaccagcuuuuacuugaucuccauuuuccugcaccucgugaagaucccaacacaucgccacgucguuggcaaacccugcccuaagccacaucgacugaaucacauggggaucuguucuugcggacuuuauaagcacccgggcgugcccguaaaauggaagagauga

SEQ ID NO: 1664 - RNA, 1473 nt, Artificial Sequence
  derived and/or modified CDS sequence (opt3) from Lassa virus__AIT17786__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacgcauaugccauagacgcugcagaucauugcggaaccauugccaacggcgugcuccaaacguucaugaggauggcuuggggcggguccuacaucgcccuggacucaggaaaggguaguugggauuguauuaugacuagcuaccaguaucuuaucauccagaauaccacaugggaagaccacugccaguuuucucggccgucccccauuggcuaccugggguugcucucacaacgcacucgagauauauauaucagccguagacuguuaggaaccuucacauggacccugagugacucugagggcaacgaaacgccugguggguacugucucacuagguggaugcuuauugaggcggagcugaaaugcuuuggaaacacagcagucgccaaguguaaugaaaaacaugaugaggaguucugcgacauguugcggcuauuugauuucaacaagcaggcuauccgcagacugaaaaccgaagcccagauguccauacagcucauuaauaaggcagugaacgcucugaucaaugaccaacuuaucaugaagaaccaccugagggacauuaugggcaucccauauugcaauuacagcaaauauugguacuugaaccacacuguaacaggcaagaccucgcucccccgguguuggcugguuucuaauggguccuacuuaaacgaaacgcauuucucagaugacauugagcagcaggccgauaauaugauaaccgagcugcuacaaaaagaauauauggaccgccagggaaagacaccucucggucugguggaucuuuuugucuucaguacuagcuuuuacuugaucuccauuuuccugcaccucgugaaaaucccaacccaucgacacaucacaggcaagcccugcccuaaaccacauagacugaaccacauggggauuuguucuugcggacuuuauaagcacccgggcgugcccgucaaguggaaaagguga

SEQ ID NO: 1665 - RNA, 1473 nt, Artificial Sequence
  derived and/or modified CDS sequence (opt3) from Lassa virus__AIT17790__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaauaccgcgguggcaaaguguaacgaaaaacaugacgaggaguucugcgauauguugcggcuauuugacuucaauaagcaggccauucgcagacugaaaacugaagcucagauguccauccagcucauaaacaaggccguaaaugcacugauuaacgaucaacuuaucaugaagaaucaccugagggacaucaugggcauuccauauugcaacuacagcaaauauugguacuugaaucacacaguuaccggcaagacgucgcucccccgguguuggcuggugucuaacggguccuacuuaaaugaaacccauuucucagacgauaucgagcagcaggcugacaacaugauuacagagcugcuacaaaaagaauauauggaucgccagggaaagacuccucucggucuggucgaccuuuuuguguucaguaccagcuuuuacuugauauccaucuuccugcaccucgugaaaauuccaacacaucgacacaucacuggcaagcccugcccuaaaccacauagacugaaucacauggggaucuguucuugcggacuuuauaagcacccgggcguccccguuaaguggaaaagguga

SEQ ID NO: 1666 - RNA, 1473 nt, Artificial Sequence
  derived and/or modified CDS sequence (opt3) from Lassa virus__AIT17798__GPC
augggccagaucauuaccuucuuucaagaggugccccacgucauagaagagguuaugaacaucgugcugauugcccucagccuucuggcuaucuugaaggggauuuacaauguagcaacaugcggauuauucggucugguguccuuucuacuccuguguggcagaucuugcucaacuacguauaaaggggucuacgaacuucagacccuggaguuggacauggccagucucaacaugacaaugccucugagcuguacuaagaauaacucccaucacuauaucauggugggaaaugaaaccggccuggagcucacauuaaccaacacuucuauaaucaaucauaaauucugcaaccugucggaugcgcacaagaaaaaucuuuacgaccaugcuuugaugucaauuaucagcacauuucaccugaguauuccaaacuucaaucaguaugaggccauguccugugauuuuaacggugggaagaucucuguucaguacaaucuaagccacaccuaugcaguggacgccgcuaaccauugcggaacgauagcaaauggcguccuccaaacuuucaugaggauggccuggggcggguccuacauugcucuggauucaggaaaggguaguugggacuguaucaugaccagcuaccaguaucuuauuauccagaacacaacuugggaagaucacugccaguuuucucggccgucccccaucggcuaccugggguugcucucacaacgcacccgagacauuuauauaagccguagacuguuaggaacauucaccuggacgcugagugauucugagggcaacgaaacuccugguggguacugucucacaagguggaugcuuaucgaggccgagcugaaaugcuuuggaaauaccgcgguggcaaaguguaacgaaaaacaugacgaggaguucugcgauauguugcggcuauuugacuucaauaagcaggccauuaugcgccugaaaacugaagcucagauguccauccagcucauaaacaaggccguaaaugcacugauuaacgaucaacuuaucaugaagaaucaccugagagacaucaugggcauuccauauugcaacuacagcaaauauugguacuugaaucacacaguuaccggcaagacgucgcuccccagguguuggcuggugucuaacggguccuacuuaaaugaaacccauuucucagacgauaucgagcagcaggcugacaacaugauuacagagaugcugcaaaaagaauaucuagaucggcagggaaagacuccucucggucuggucgaccuuuuuguguucaguaccagcuuuuacuugauauccaucuuccugcaccucgugaaaauuccaacacaucgccacaucaucggcaagcccugcccuaaaccacaucgacugaaucacauggggauuuguucuugcggacuuuauaagcacccgggcguccccguuaaguggaaaagauga

SEQ ID NO: 1667 - RNA, 1476 nt, Artificial Sequence
  derived and/or modified CDS sequence (opt3) from Lassa virus__AIT17802__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaagaacaauagucaucacuauaucauggugggaaacgagaccggcuuagagcugacucuuacaaauaccagcauuaucaaccauaaauuuugcaauuuguccgacgcccacaagaaaaaccuguacaaucaugcgcuaaugucuauaaucucgacguuccaccucucaauuccaaacuuuaaucaguaugaagcuaugagcugugauuucaacggugggaagaucaguguccaguacaaucugucccacucuuaugccggagacgcagccaaccauugcggcacuguggcuaacggcguacuucaaaccuuuaugaggauggcauggggagggagcuacauugcccuggauuccggucgggaccgcugggauuguaucaugacaucauaccaguauuugauaauucagaauacuaccugggaggaccacugccaguucagucgaccgagccccaucggcuaccucgggcuguuaucucaacguacaagagauauuuauaucuccaggcggcugcucggaaccuuuacguggacucuuucagacagcgaaggcaaggauacaccugguggguacugucugacccgcuggauguugaucgaggcugagcuaaaaugcuucggaaacacugccguugcgaaguguaaugaaaaacaugacgaggaauuuugcgauaugcugagacucuucgacuuuaacaagcaggcaauucagaggcugaaagccgaggcucagaugaguauacaacuuaucaauaaggccgugaacgcacugauuaaugaucaguugaucaugaagaaccaccuccgggacauaaugggcauuccauauugcaauuacucuaaauauugguaccugaaccacacaaccacgggcaagaccuccuuacccaaauguuggcuggucagcaaugggucguaccuaaacgaaacacauuucucugacgauaucgagcagcaagcugacaauaugaucacugagaugcuccagaaggaauauauggagcgccugggaaaaaccccucuugguuugguggaucuguucguguuuuccacaucauucuaccucauuaguaucuuucugcaccuugucaagauuccaacucaucgacacauaguuggcagaagcugccccaaaccucauaggcugaaccacauggggaucuguuccugcggauuguauaagcagccaggcgugccgguaaaguggaaacgguga

SEQ ID NO: 1668 - RNA, 1476 nt, Artificial Sequence
  derived and/or modified CDS sequence (opt3) from Lassa virus__AIT17806__GPC
augggccagaucgugaccuucuuucaagaggucccccacguuauugaagaggugaugaacauaguacugaucgcccucagcauucuugcugugcugaagggguuguacaauuucgcaacaugcggauuaaucggucuggucacuuuucuacuccuguguggcagauccugcacgaccucucuuuauaaagggguguacgaacugcagacauuggagcucaacauggaaacucugaauaugaccaugccucugucauguacaaagaacaauagucaucacuauauuaugguuggaaacgagaccggccucgaguuaacucugacaaauaccagcaucauaaaccauaaauucugcaaucuuuccgacgcccacaagaaaaacuuguacgaucaugcgcugaugucuaucauuucgacguuucaccuaucaaucccaaauuucaaccaguaugaagcuaugagcugugacuuuaauggugggaagauuagugugcaguacaaccucucccacucuuaugccggagaugcagccaaucauugcggcacugucgcuaacggcgugcugcaaaccuucaugaggauggcauggggagggagcuacaucgcccuugacuccggucggggcaagugggauuguauaaugacaucauaccaguaucugauuauccagaacacuaccugggaggaccacugccaguuuagucgcccgagccccauuggguacuugggacuccugucucaacgaacacgugauaucuauaucuccagaagguuacugggcaccuucacguggacucucucagacagcgaagguaaagauacaccugggggauacugucuuacccgguggaugcugauugaggcugaguugaagugcuuuggcaauacugccguagcgaaauguaacgaaaagcaugacgaggaguucugcgauaugcuacgccuguuugacuucaauaaacaggcaauacagagacucaaggccgaagcucagaugaguauccaacugauuaacaaggccguuaaugcacuuaucaacgaucagcugauaaugaaaaaucacuugagggacauuaugggcaucccauauugcaacuacucuaaguauugguaccucaaucacacaaccacggggaaaaccucccugcccaaguguugguuagugagcaacggaucguaccugaaugaaacacauuucucugacgauaucgagcagcaagcugacaacaugauuacugagaugcuacagaaagaauauauggagcggcaggguaagaccccucucggccuggucgaucuuuuuguguucuccacaucauuuuacuugaucaguauuuuccugcaccucgugaaaauaccaacucaucgccacaucgucggaaagagcugccccaagccucaucgacugaaucacauggggauuuguuccugcggccuuuauaaacagccagguguuccggugaaguggaaaagauga

SEQ ID NO: 1669 - RNA, 1476 nt, Artificial Sequence
  derived and/or modified CDS sequence (opt3) from Lassa virus__AIT17810__GPC
augggccagaucgugaccuucuuucaagaggucccccacguuauugaagaggugaugaacauaguacugaucgcccucagcauucuugcugugcugaagggguuguacaauuuagcaacaugcggacuggucggucuagugacuuuccuccugcuuuguggcagauccugcacgaccucucuguauaaagggguuuacgaauugcagacacucgagcugaacauggaaacucugaauaugaccaugccucucucauguacaaaggacaacagucaucacuauaucagggugggaaaugagaccggcuuagagcugacucuuacaaacaccagcauuuugaaucauaaauuuugcaaccuguccgaugcccacaagaaaaaucuauacgaccaugcgcucaugucuaucauaucgacguuccaccugucaaucccaaacuuuaaucaguaugaagcuaugagcugugauuucaacggugggcggauuaguguccaguacaaucuuucccacucuuaugccggagacgcagccaaccauugcggcacuguggcuaauggcguacugcaaaccuuuaugcgcauggcauggggagggagcuacaucgccuuggauuccggucgaggccguugggacuguauuaugacaucauaccaguaucucaucauacagaacacuaccugggaggaucacugccaguucaguagaccgagccccauuggguaccugggauuacugucucaaaggacacgggacaucuauauuucccgcagacuccuuggcaccuuuacguggacucugucagauagcgaagguaaggacacaccugggggauacuguuugaccagguggaugcuaaucgaggcugagcugaagugcuucggcaacacugccguugcgaaauguaaugaaaagcaugaugaggaauuuugcgacaugcuccggcuguucgauuuuaacaaacaggcaauccagcgccuuaaggccgaggcucagaugaguauucaacugauaaauaaagccgugaacgcauugaucaaugaccagcucauuaugaagaaccaucugcgagacaucaugggcauaccauauugcaauuacucuaaguauugguacuuaaaccacacaaccacggggaaaaccucccugcccagauguuggcuagucagcaauggaucguaccucaacgaaacacacuucucugaugacauugagcagcaagcugauaauaugaucacugagaugcugcagaaggaauauauggagaggcaggguaaaaccccucuuggcuugguggaccuguucguguuuuccacaucauucuaccucaucaguauuuuucugcaccuugucaagaucccaacucaucggcacguuguggggaaacccugcccuaagccacaucgucugaaccacaugggaauuuguagcugcggcuuguauaaacagccggguguacccgugaaguggaagcgcuga

SEQ ID NO: 1670 - RNA, 1476 nt, Artificial Sequence
  derived and/or modified CDS sequence (opt3) from Lassa virus__AIT17814__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucgaccauaaauucugcaaccuuuccgaugcccacaggaagaauuuguacgaccaugcgcugaugucuauaaucucgacguuucaccuaucaauuccaaacuucaaucaguaugaagcuaugagcugugauuuuaacggugggaaaaucaguguccaguacaaucucucccacucuuaugccaaggacgcagccgaucauugcggaacuguggcuaacggcguacugcaaaccuucaugcggauggcauggggcgggagcuacauugcccuugacuccggacgcggucgaugggauuguaucaugacaucauaccaguaucugauaauucagaauacuaccugggaggaccacugccaguuuagucguccgagccccaucggcuacuuggggcuccugucucaaagaacaagggauauuuauaucucccggcgcuuacugggaaccuucacguggacucucucagacagcgaaggcaaggauacaccugguggguacugucuuaccagauggaugcugaucgaggcugaguugaaaugcuuuggaaacacugccguugcgaaguguaacgaaaaacaugacgaggaguucugcgauaugcuaaggcuguuugacuucaauaagcaggcaauucagcggcucaaagccgaagcucagaugaguauacaacugaucaacaaggccgugaaugcacuuauuaacgaccagcugaucaugaagaaucacuugcgcgauauaaugggcauuccauauugcaacuacucuaaauauugguaccucaaucacacaaccacgggcaagaccucccugcccaaauguugguuagucagcaacgggucguaccugaaugaaacacauuucucugacgauaucgagcagcaagcugacaacaugaucacugagaugcuacagaaggaauauauggagcgacagggaaaaaccccucucggucugguggaucuuuuuguguucuccacaucauuuuacuugauuaguaucuuccugcaccucgucaagauuccaacucauagacacauaguuggcaaacccugcccuaagccacauaggcugaaucacauggggaucuguagcugcggacuuuauaagcagccgggcgugcccguaaaauggaagcgguga

SEQ ID NO: 1671 - RNA, 1476 nt, Artificial Sequence
  derived and/or modified CDS sequence (opt3) from Lassa virus__AIT17820__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaagggguuuacgaacugcagacauuggagcucaacauggaaacucugaauaugaccaugccucugucauguacaaagaacaauagucaucacuauaucauggugggaaacgagaccggccucgaguuaacucugacaaauaccagcauuaucaaccauaaauucugcaaucuuuccgacgcccacaagaaaaacuuguacgaucaugcgcugaugucuauaaucucgacguuucaccuaucaauuccaaauuucaaccaguaugaagcuaugagcugugacuuuaauggugggaagaucaguguccaguacaaccucucccacucuuaugccgaggaugcagccaaucauugcggaacuguggcuaacggcguacugcaaaccuucaugaggauggcauggggcgggagcuacauugcccuugacuccggacgggguaacugggauuguaucaugacaucauaccaguaucugauaauucagaauacuaccugggaagaccacugccaguuuagucgcccgagccccaucggcuacuuggggcuccugucucaacgaacacgugauauuuauaucuccagaagguuacugggaaccuucacguggacucucucagacagcgagggcaaggauacaccugguggguacugucuuacccgguggaugcugaucgaggcugaauugaaaugcuuuggaaacacugccguugcgaaguguaaugagaaacaugacgaagaguucugcgauaugcuacgccuguuugacuucaacaagcaggcaauucagagacucaaagccgaagcucagaugaguauacaacugaucaauaaggccgugaacgcacuuauuaaugaucagcugaucaugaagaaccacuugagggacauaaugggcauuccauauugcaauuacucuaaauauugguaccucaaccacacaaccacgggcaagaccucccugcccaaauguugguuagucagcaaugggucguaccugaacgagacacauuucucugacgauaucgagcagcaagcugacaauaugaucacugaaaugcuacagaaggaguauauggaacggcagggaaaaaccccucucggucugguggaucuuuuuguguucuccacaucauuuuacuugauuaguaucuuccugcaccucgucaagauuccaacucaucgccacauaguuggcaaaagcugccccaagccucaucgacugaaccacauggggaucuguuccugcggacuuuauaagcagccaggcgugccgguaaaauggaagagauga

SEQ ID NO: 1672 - RNA, 1476 nt, Artificial Sequence
  derived and/or modified CDS sequence (opt3) from Lassa virus__AIT17824__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucuguuuauaaagggguguacgaacuucagacacuggaguugaacauggaaacucucaauaugaccaugccucugucauguacaaagaacaauagucaucacuauaucauggucggaaacgagaccggccuggagcucacuuuaacaaauaccagcauuaucaaccauaaauucugcaaucuguccgacgcccacaagaaaaaccuuuacgaucaugcguugaugucuauaaucucgacguuucaccugucaauuccaaauuucaaccaguaugaagcuaugagcugugacuuuaauggugggaagaucagugugcaguacaaccuaucccacucuuaugccggagaugcagccaaucauugcggcacuguagcuaacggcguucuccaaaccuucaugaggauggcauggggagggagcuacauugcccuggacuccggucacggcaagugggauuguaucaugacaucauaccaguaucuuauaauucagaacacuaccugggaggaccauugccaguuuagucggccgagccccaucggguaccugggauugcucucucaacgcacacgagauauuuauaucucccguagacuguuaggcaccuucacguggacucugucagacagcgaagguaaagauacaccugggggauacugucucaccagguggaugcuuaucgaggcugagcugaagugcuuuggcaauacugccguggcgaaauguaacgaaaagcacgacgaggaguucugcgauauguugcggcuauuugacuucaauaaacaggcaauucagcgccugaaggccgaagcucagaugaguauacaacucaucaacaaggccgucaaugcacugauuaacgaucagcuuaucaugaaaaaucaccugagagacauaaugggcauuccauauugcaacuacucuaaguauugguacuugaaucauacaaccacggggaaaaccucccuccccaaguguuggcuggugagcaacggaucguacuuaaaugaaacacacuucucugacgauaucgagcagcaagcugacaacaugaucacugagaugcugcagaaagaauauauggagaggcaggguaagaccccucuaggccucguggaucuguuugucuucuccacaucauuuuaccuuauuaguaucuucuugcaucugguuaaaauuccaacucaccggcauauagugggaaagagcugccccaagccucaccgccucaaucacauggggaucuguuccugcggccuguauaaacagccagguguaccggugcgauggaagagauga

SEQ ID NO: 1673 - RNA, 1476 nt, Artificial Sequence
  derived and/or modified CDS sequence (opt3) from Lassa virus__AIT17828__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaccucucuuuauaaaggggacuacgaacugcagacauuggagcucaacauggaaacucugaauaugaccaugccucugucauguacaaagaacaauagucaucacuauaucaugguuggaaacgagaccggccucgaguuaacucugacaaauaccagcauuaucaaccauaaauucugcaaucuuuccgaugcccacaagaaaaacuuguacgaccaugcgcugaugucuauaaucucgacguuucaccuaucaauuccaaauuucaaccaguaugaagcuaugagcugugauuuuaauggugggaagaucagugugcaguacaaccucucccacucuuaugccggagacgcagccaaucauugcggcacugucgcuaacggcgugcugcaaaccuucaugaggauggcauggggagggagcuacauugcccuugauuccggucggggcaacugggacuguaucaugacaucauaccaguaucugauaauucagaauacuaccugggaggaucacugccaguuuagucgcccgagccccaucggguacuugggacuccugucucaacgaacacgugacauuuauaucuccagaagguuacugggcaccuucacguggacucucucagauagcgaagguaaggacacaccugggggauacugucuuacccgguggaugcugaucgaggcugaguugaaaugcuuuggcaacacugccguagcgaaguguaaugaaaaacaugaugaggaguucugcgacaugcuacgccuguuugauuucaacaagcaggcaauucagagacucaaagccgaagcucagaugaguauacaacugaucaauaaggccguuaacgcacuuauuaaugaccagcugaucaugaagaaccacuugagggacauaaugggcauuccauauugcaauuacucuaaauauugguaccucaaccacacaaccacggggaagaccucccugcccaaauguugguuagugagcaauggaucguaccugaacgaaacacauuucucugaugacaucgagcagcaagcugauaauaugaucacugagaugcuacagaaggaauauauggagcggcaggguaaaaccccucucggccuggucgaccuuuuuguguucuccacaucauuuuacuugauuaguaucuuccugcaccucgugaagauuccaacucaucgccacauagucgggaaaagcugccccaagccucaucgacugaaccacaugggaaucuguuccugcggccuuuauaagcagccagguguuccggugaaauggaagagauga

SEQ ID NO: 1674 - RNA, 1473 nt, Artificial Sequence
  derived and/or modified CDS sequence (opt3) from Lassa virus__AIT17836__GPC
augggccagaucauuaccuucuuucaagaggugccccacgucauagaagagguuaugaacaucgugcugauugcccucagccuucuggcuaucuugaagggguuauacaauauugcaacaugcggaaucauaggucugguagccuuccuauuucucuguggcaaauccugcucucugacucuuaaagggggauaugaacugcagacguuggagcucaacauggaaacccugaauaugacaaugccucugucauguacuaagaacaguagccaucacuacaucagagugggcaaugagaccggucucgaguuaacacugaccaacacuuccauuaucaaucauaaguucugcaaccuuucugacgcgcacaaaaagaauuuguaugaucaugcucugaugucgauuaucucaacauuucaccuaagcauaccaaacuucaaucaguacgaagccaugaguugugacuuuaacgggggaaagauuuccguccaguauaaucucucucacagcuacgcaggcgaugccgcugagcauugcggcaccguggcaaacgggguucugcaaacguucaugaggauggccuggggaggucgguauaucgcucuugacuccggcaaagggaauugggauuguauuaugacuucauaccaguaccugaucauccagaacaccacaugggaagaccacugccaguuuagucgcccgagccccauuggauauuugggccuccugucucaacgaacucgugauauauacaucuccagaagguuacuggguaccuucacauggacccucucagacagcgaggggaacgagacgccuggaggcuauugucuuacucgguggaugcugauugaagccgaguugaagugcuuuggcaauacagcgguggcaaaauguaacgaaaagcaugaugaggaguucugcgacaugcuacgccuguuugauuucaauaaacaggccaucagaaggcucaaggcugaagcccagaugaguauacagcugauuaacaaggcagucaaugcucuuaucaacgaccaacugaucaugaaaaaucacuugcgggauauuauggggaucccauacugcaacuauucuaaguacugguaucucaaucacaccuccagcggacgcacuucgcugcccaaauguugguuaauuucuaacgguuccuaccugaaugagacacaguucucagacgacauagaacagcaagccgauaacaugaucaccgagaugcuacagaaggaauacauugagcgacagggcaaaacgccucucgggcugguggacaucuuuaucuucaguaccagcuuuuaucuuauuuccauauucuugcaucugaucaagauuccaacacacagacauaucguaggaaaacccugcccuaagccacacaggcucaaucauaugggcguuuguucuugcggucuguacaagcacccgggggugcccacuaaauggaagcgguga

SEQ ID NO: 1675 - RNA, 1476 nt, Artificial Sequence
  derived and/or modified CDS sequence (opt3) from Lassa virus__AIT17840__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaucucucuuuauaaagggguuuacgaacugcagaccuuggagcucaacauggaaacacugaauaugacuaugccucugucauguaccaagaacaauagucaucacuauauuauggugggaaacgagacaggccucgaguuaacccugacuaauacaagcaucauaaaccauaaauucugcaaucuuuccgacgcccacaagaaaaacuuguacgaucaugcgcugaugucuaucauuucgaccuuucaccuaucaaucccaaauuucaaccaguaugaagcuaugagcugugacuuuaauggugggaagauuaguguccaguacaaccucucccacucuuaugccggagaugcagccaaucauugcggcacgguggcuaacggcguacugcaaacuuucaugaggauggcauggggagggagcuacaucgcccuugacuccggucgggaucgcugggacuguauaaugaccucauaccaguaucugauuauccagaacacaacuugggaggaucacugccaguuuagucgaccgagccccauuggcuacuuggggcuccugucucaacguaccagagacaucuauaucuccaggcgguuacugggaacauucaccuggacgcucucagauagcgaaggcaaggacacuccugguggguacugucuuacacgcuggaugcugauugaggcugaguugaaaugcuuuggaaauaccgccguugcgaaguguaacgaaaaacaugaugaggaguucugcgacaugcuaagacuguuugauuucaauaagcaggcaauacagaggcucaaagccgaagcucagaugaguauccaacugauuaacaaggccgugaaugcacuuaucaacgaccagcugauaaugaagaaucacuugcgggacauuaugggcaucccauauugcaacuacucuaaauauugguaccucaaucacacuacaaccggcaagacgucccugcccaaauguugguuagucagcaacgggucguaccugaaugaaacccauuucucugaugacaucgagcagcaagcugauaacaugauuacagagaugcuacagaaggaauauauggagcgccagggaaaaacuccucucggucugguggaccuuuuuguguucuccaccucauuuuacuugaucaguauuuuccugcaccucgucaagauaccaacacaucgacacaucguuggcaaacccugcccuaagccacauagacugaaucacauggggauuuguagcugcggacuuuauaagcagccgggcgugcccguaaaauggaagagguga

SEQ ID NO: 1676 - RNA, 1476 nt, Artificial Sequence
  derived and/or modified CDS sequence (opt3) from Lassa virus__AIT17844__GPC
augggccagaucgugaccuucuuucaagaggucccccacguuauugaagaggugaugaacauaguacugaucgcccucagcauucuugcugugcugaagggguuguacaauuucgcaacaugcggauuagucggucuggugacuuuucuacuccuguguggcagauccugcacgaucucucuuuauaaagggguuuacgaacugcagaccuuggagcucaacauggaaacacugaauaugacuaugccucugucauguaccaagaacaauagucaucacuauauuauggugggaaacgagacaggccucgaguuaacccugacuaauacaagcaucauaaaccauaaauucugcaaucuuuccgacgcccacaagaaaaacuuguacgaucaugcgcugaugucuaucauuucgaccuuucaccuaucaaucccaaauuucaaccaguaugaagcuaugagcugugacuuuaauggugggaagauuaguguccaguacaaccucucccacucuuaugccggagaugcagccaaucauugcggcacgguggcuaacggcguacugcaaacuuucaugaggauggcauggggagggagcuacaucgcccuugacuccggucgggaucgcugggacuguauaaugaccucauaccaguaucugauuauccagaacacaacuugggaggaucacugccaguuuagucgaccgagccccauuggcuacuuggggcuccugucucaacguaccagagacaucuauaucuccaggcgguuacugggaacauucaccuggacgcucucagauagcgaaggcaaggacacuccugguggguacugucuuacacgcuggaugcugauugaggcugaguugaaaugcuuuggaaauaccgccguugcgaaguguaacgaaaaacaugaugaggaguucugcgacaugcuaagacuguuugauuucaauaagcaggcaauacagaggcucaaagccgaagcucagaugaguauccaacugauuaaccgggccgugaaugcacuuaucaacgaccagcugauaaugaagaaucacuugcgcgacauuaugggcaucccauauugcaacuacucuaaguauugguaccucaaucacacuacaaccggcaaaacgucccugcccaaguguugguuagucagcaacgggucguaccugaaugaaacccauuucucugaugacaucgagcagcaagcugauaacaugauuacagagaugcuacagaaagaauauauggagcgacagggaaagacuccucucggucugguggaccuuuuuguguucuccaccucauuuuacuugaucaguauuuuccugcaccucgucaaaauaccaacacauagacacaucguuggcaagcccugcccuaaaccacauaggcugaaucacauggggauuuguagcugcggacuuuauaagcagccgggcgugcccguaaaguggaaacgguga

SEQ ID NO: 1677 - RNA, 1473 nt, Artificial Sequence
  derived and/or modified CDS sequence (opt3) from Lassa virus__AMR44577__GPC
augggccagaucauuaccuucuuucaagaggugccccacgucauagaagagguuaugaacaucgugcugauugcccucagccuucuggcuaucuugaaggggguauacaauguggcaacaugcggaauuaucgguuuagucacuuuccuguuucuauguggcagauccugcucucucauauauaaagggucauacgaacugcagacgcuugagcugaacauggaaaccuugaauaugacaaugccucucaguuguacuaagaacagcucccaucacuauaucagggugggaaaugagaccggccuggagcugacacucaccaacacuucuauuaucaaucauaaauucugcaacuuaucggacgcccacaagcggaaucuguacgaucaugcgcuuaugucaauuuugagcacauuucaccugaguaucccaaacuucaaucaguaugaagcuauguccugugacuuuaacggugggaaaauaucuguucaguacaaucuaagccacgccuaugcaguggaugccgcugagcauugcggaaccgucgcaaacggcgugcuccaaacguucaugcgcauggccuggggcggguccuacauugcucuggacucaggacgagguaauugggauuguaucaugaccaguuaccaguaucuuauuauccagaacacuacaugggaagaccacugccaguuuagccguccgucucccaucggcuaccugggguugcucucccaaagaacuagggauauuuauauaucacggcgccuguuaggaaccuucacauggacccugagcgacagugagggcaacgagacgccugguggguacugucucacuagauggaugcuuaucgaagccgagcugaagugcuuuggaaauacagcgguagcaaaguguaacgaaaaacaugaugaggaguucugcgacauguugaggcuauuugauuucaauaagcaggccauucagcggcugaaaucugaagcucagauguccauccaacucauaaacaaggccguuaaugcacugauuaacgaccagcuuaucaugaaaaaucaucugcgcgauaugaugggcaucccauauugcaacuacagcaaguauugguacuugaaucacaccucgucuggccgaacuucccuccccaaguguuggcuggugucaaacgggaguuacuuaaaugagacacacuucagcgacgacauugaacagcaagcugauaacaugaucaccgagaugcugcagaaagaauauauugacagacagggaaagacgccucuaggucucgucgaucuguuuguguucuccaccucuuuuuaccuuauaagcaucuucuugcaccugauuaaaaucccaacacauaggcacaucgugggcaagcccugcccuaaaccacaucggcucaaucacauggggauuuguucaugcggacuguauaagcagccgggcguccccacucguuggaaacgcuga

SEQ ID NO: 1678 - RNA, 1476 nt, Artificial Sequence
  derived and/or modified CDS sequence (opt3) from Lassa virus__ANH09722__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuacuccuguguggcagauccugcacgaccacacuuuauaaagggguuuacgaacugcaggccuuggagcucaacauggaaacucugaauaugaccaugccucugucuuguacaaagaacaauucacaucacuauauuagggugggaaacgagaccggccucgaguuaacucugacaaauaccagucuuaucaaccauaaauuuugcaauuugagcgacgcgcacaagaaaaaccuguacgaucaugcucuaauguccauaaucucuacguuccaccucucgauuccaaauuuuaaccaguaugaagccaugucaugugacuucaaugaugguaagaucagcguccaguacaaccugagucacacuuaugcaggggacaccgccaaucauugcggaacaguggcuaacggcguacuucaaacuuuuaugcggauggcauggggcggguccuacauugcccuggauucuggacgcgguggcugggacuguaucaugaccagcuaccaguauuugauaauucagaacacaaccugggaggaucacugccaguucucccgaccgucacccaucggguaccucggacuguuaagucaacguacgagagacauuuauaucagcaggcggcugcucggcacuuuuacauggacccuuucugauuccgaagguaaggacacuccugggggauacugucugacacgcuggauguugaucgaggcugagcuaaaaugcuucggcaauaccgccguugcgaaguguaacgaaaaacaugaugaggaauuuugcgacaugcugagacucuucgauuuuaauaagcaggcaauucagaggcugaaagccgaggcucagaugucaauacaacuuaucaacaaggccgugaaugcacugauuaacgaccaguugaucaugaagaaucaccuccgggacauaaugggcauuccauauugcaacuacagcaaauauugguaccugaaucacacggucaccgggaagacaaguuuacccaaauguuggcuggugucuaacggauccuaccuaaaugaaacucauuucagcgaugacaucgagcagcaagcugauaacaugaucaccgagaugcuccagaaggaauauauggagcgccaggguaaaacaccucugggccuuguggacuuguucgucuuuucgacuucuuucuaccugauuuccaucuuucuccaccugguuaagauuccaacccaucgacacgugguagggaaacccugcccuaagccacauagacuuaaucacaugggaauauguucaugcggcuucuauaagcagccgggugugcccgucagguggaaacgguga

SEQ ID NO: 1679 - RNA, 1476 nt, Artificial Sequence
  derived and/or modified CDS sequence (opt3) from Lassa virus__ANH09724__GPC
augggccagaucgugaccuucuuucaagaggucccccacguuauugaagaggugaugaacauaguacugaucgcccucagcauucuugcugugcugaagggguuguacaaugucgcaacaugcggauuaaucggucuggugacuuuccuacuccuguguggcagauccugcacgaccacacuuuauaaagggguuuacgaacugcaggccuuggagcucaacauggaaacucugaauaugaccaugccucugucuuguacaaagaacgacucacaucacuauauuauggugggaaaugagaccggccucgaguuaacucugacaaacaccaguaucauaagccauaaauuuugcaaucuuuccgaugcgcacaagcagaacuuguacgaccaugcucugaugucuaucauuucgacguuccaccuaucaaucccaaauuuuaaccaguaugaagccaugagcugugauuucaauggugggaaaauuaguguccaauacaaccucucccacacuuaugcaggagacgccgcuaaucauugcggcaccguggcaaacggcguacugcagacauuuaugaggauggccuggggagggucuuacaucgcucuugauagcggucggggcgggugggacuguauaaugacuuccuaccaguaucugauuauccagaauaccacaugggaggaucacugccaauucucacgcccgagucccauuggauacuugggccuccugagccagcgaacccgugacaucuauaucucuagaagguuacuggguacguuuacuuggacacucuccgauucagaagggaaggacaccccuggaggcuacugucuuacucgguggaugcugauugaggccgaguugaagugcuucggcaacacagcgguugcaaaauguaacgaaaagcaugaugaggaauuuugcgacaugcuacgccuguucgauuuuaauaaacaggccauacagagacucaaggcugaggcccaaaugagcauccagcugauuaacaaagcagugaaugcucuuaucaacgaccagcugauaaugaagaaucacuugagggacauuauggggaucccauauugcaacuacaguaaguauugguaccucaaucacaccgucacgggaaaaaccucucugcccaaguguugguuaguguccaacgguagcuaccugaaugaaacacauuucucggaugacaucgagcaacaggccgauaacaugauuacugagaugcuacagaaagaauauauggagcggcagggcaagaccccucucgggcugguggaccuuuucgucuuuucuacauccuucuacuugaucucaauuuuucugcaccucguuaaaauaccaacucaucgccacgugguaggaaagcccugcccuaaaccacaucgacugaaucacaugggcaucuguaguugcgguuucuaugggcaaccgggcgugcccgucagauggaagagguga

SEQ ID NO: 1680 - RNA, 1476 nt, Artificial Sequence
  derived and/or modified CDS sequence (opt3) from Lassa virus__ANH09728__GPC
augggccagaucgugaccuucuuucaagaggucccccacguuauugaagaggugaugaacauaguacugaucgcccucagcgugcuugcuguccugaagggguuguacaauguggcaacaugcggauuaauuggucugguuacuuuccuacuccuguguggcagauccugcacgaccacacuuuauaaagggguguacgaacugcaggccuuggagcucaacaugggaacucugaauaugaccaugccucugucuuguacaaagaacaauucacaucacuauaucauggucggcaacgaaaccggucucgaguuaacucugacaaauaccaguauuaucaaccauaaauuuugcaaucuuagcgacgcgcacaagaaagauuuguacgaccaugcucugauguccauaaucucuacguuccaccuaucggugccaaacuuuaaucaguaugaggccaugucaugugauuucaacgggggaaagauuagcguacaguacaaucucagucacgcauaugccggcgacacugcuaaccauugcggcaccguugcaaauggggugcugcaaacauuuaugaggauggccuggggagguuccuacaucgcucuugauucuggccgcgggggaugggacuguauuaugacuagcuaccaguaucugaucauacagaacaccacaugggaagaucacugccaguucucccggccgucacccauuggcuacuugggucuccugagucaacgaacccgugacaucuauauuagcagaagguuacuggggacguuuacuuggacacucucugauuccgagggagaauacaccccuggcggcuauugucuuacucgguggaugcugaucgaggccgaguugaagugcuucgggaacacagcggucgcaaaauguaaugaaaagcaugacgaggaauuuugcgauaugcuacgccuguucgacuuuaacaaacaggccauccagagacucaaggcugaggcccagaugucaauucaacugauaaauaaagcagugaacgcucuuaucaaugaucagcugauuaugaagaaccacuugagggacaucaugggaauaccauacugcaauuauagcaaguacugguaccucaaccacaccgugacggguaaaaccagucugcccaaguguugguuagucucuaauggcuccuaucugaacgaaacacauuucagcgacgauauugagcagcaagccgacaauaugaucacugagaugcuacagaaagaauacauggagcggcaggggaagaccccucucggacugguugaucuuuucguguuuucgacaucuuucuauuugaucuccauuuuucugcaccucguaaaaaucccaacucaucgccacguggucggcaagcccugcccuaaaccacaucgacugaaccacauggguauuuguucaugcggguucuacaagcagccgggcgugcccguuagauggaagagguga

SEQ ID NO: 1681 - RNA, 1476 nt, Artificial Sequence
  derived and/or modified CDS sequence (opt3) from Lassa virus__ANH09730__GPC
augggccagaucgugaccuucuuucaagaggucccccacguuauugaagaggugaugaacauaguacugaucgcccucagcgugcuugcuguccugaagggguuguacaauguggcaacaugcggauuaauuggucugguuacuuuccuacuccuguguggcagauccugcacgaccacacuuuauaaagggguguacgaacugcaggccuuggagcucaacauggaaacucugaauaugaccaugccucugucuuguacaaagaacaauucacaucacuauaucauggucggaaacgagaccggccucgaguuaacucugacaaauaccaguauuaucaaccauaaauuuugcaaucuuagcgacgcgcacaagaaaaacuuguacgaucaugcucugauguccauaaucucuacguuccaccuaucgauuccaaauuuuaaccaguaugaagccaugucaugugacuucaaucaggguaagaucagcgugcaauacaaccucagucacgcauaugccggggaugcugcaaaucauugcggaacuguagccaacggcguucugcagaccuuuaugaggauggcuuggggcggguccuacauugcccuugacucuggacgggguggcugggauuguaucaugacaagcuaccaguaucugauaauucagaacacuaccugggagaaucacugccaauucucccgcccgucacccaucggguacuugggacuccugagucagcgaacacgugacauuuauaucagcagaagguuacugggcaccuuuacguggacucucucugauuccgaagguaaggggacaccuggaggcuacugucuuacccgguggaugcugaucgaggcggaguugaaaugcuucggcaacacugcaguggccaaguguaaugaaaaacaugacgaggaauuuugcgauaugcuacgccuguucgacuuuaacaagcaggcuauucagagauucaaagccgaggcacaaaugucaauacagcucaucaauaaggcugucaacgcccugauuaaugaucagcuuaucaugaagaaccaccugagggacauaauggggauuccauauugcaauuacagcaaauauugguacuugaaccacacagugaccggaaagacgagucuccccaaauguuggcuggugucuaaugguuccuacuuaaacgaaacccauuucagcgaugacaucgagcaacaggcggacaauaugaucacagagaugcugcagaaggaauauauggagcggcagggccgcacuccucuagggcucgucgaucuguuuguuuucucgaccucuuuuuaccuuauuuccaucuucuugcaccuggugaaaauuccaacacaucgacacguagugggaaagcccugcccuaaaccacauagacucaaccacaugggcauauguucaugcgguuuuuauaagcaaccggggguccccgugagguggaagcgguga

SEQ ID NO: 1682 - RNA, 1476 nt, Artificial Sequence
  derived and/or modified CDS sequence (opt3) from Lassa virus__ANH09732__GPC
augggccagaucgugaccuucuuucaagaggucccccacguuauugaagaggugaugaacauaguacugaucgcccucagcauucuugcugugcugaagggggucuacaauguggcaacaugcggauugaucgguuuaguuacuuuccugcuacucuccggcagaucuuguacgaccacaauuuauaaagggguguacgaacugcaggcccuugagcugaacauggaaacuuugaauaugaccaugccucucucaugcacaaagaacaauagucaucacuauaucauggucggaaacgagaccggccuggagcugacucucacaaauaccagcauaaucaaccauaaauuuuguaauuuauccgacgcgcacaagaaaaaccuguacgaucaugcucuuaugucuauuaucucgacguuccacuugucaauuccaaauuuuaaccaguaugaagccaugagcugcgacuucaauggugggaagaucagugugcaguacaaccugucccacacuuaugcaggagaugccgcuaaucauuguggcaccguagcaaacggcguucuacaaacauuuaugaggauggccuggggagggucuuacauagcucucgacagcggucacggcgggugggauugcauuaugacuuccuaccaguaucugaucauucagaacaccacaugggagaaucauugucaguucucacggccgagucccaucggauaccuuggccuguugagccaacgcacccgagacaucuauauuucucguagacuccuggguacguuuacuuggacauuauccgauucagaagggaaggacaccccuggaggcuacugccugacuagguggaugcucauagaggccgagcuuaaauguuucggcaacacagcgguggcaaagugcaaugaaaaacacgaugaggaauuuugugacaugcugcgguuguucgauuuuaacaagcaggccauccagcgccuaaaagcugaggcccagaugagcauucaacugaucaauaaggcagucaacgcucucauaaaugaccagcugauuaugaagaaccaccuuagagauaucauggggaucccauauugcaauuacaguaaauauugguaccugaaccauaccgugacgggaaagaccucuuugcccaaaugcuggcucguguccaaugguagcuaccugaacgaaacacacuucucggacgacauugagcagcaagccgauaauaugaucacugagauguuacagaaggaauauauggagaggcagggcaaaaccccucuggggcuagucgaccucuucguguuuucuacauccuucuaccugauuucaauauuucuucauuugguuaagaucccaacucaccggcauauuguaggaaaacccuguccuaagccacaccgccugaaccacaugggcaucugcaguugugguuucuauaagcagccgggggugcccguccgauggaaaagauga

SEQ ID NO: 1683 - RNA, 1473 nt, Artificial Sequence
  derived and/or modified CDS sequence (opt3) from Lassa virus__ANH09738__GPC
augggccagaucgugaccuucuuucaagaggucccccacguuauugaagagauaaugaacaucgugcugauuacacucagccuucuggccaucuugaagggguuauacaauuucgcuacuugcggacugauuggucuaaucacguuucucuuccuguguggcagauccugcucuaugauauauaaagggucauaccagcuugaaacccuggaguugaacauggaaacacucaauaugacuaugccucugaguuguaccaagaacaauagccaucacuauaucaggguaggaaacgagacaggccuggagcucaccuuaacuaauacauccauuaucaaccauaaauuuugcaaucugucugacgcacacaagcggaaccuuuacgaucauucguugaugucaauuaucagcaccuuccaccugaguauaccaaauuuuaaccaguaugaagccauguccugugacuucaauggugggaaaauuucuauccaguacaaccuaagccacacguaugcgggagaugcugccaagcauugcggcacuguggcaaauggcguccuccaaaccuuuaugcgcauggccuggggaggguccuacauugcucuggacucaggucgaggcaacugggauuguaucaugacaaguuaccaguaucuuaucauucagaacacuaccugggaggaccacugccaguucagccguccgucucccauaggguaccugggauugcucucccaaagaacaagggauaucuauauuucacggcgccuguuaggcaccuuuacguggacucugagcgacagugaagguaaggagacaccugggggauacugucucaccagauggaugcuuaucgaggcagaacugaaaugcuucggcaauacugccguggcuaaguguaacgagaaacaugaugaagaguuuugcgacauguugaggcuauucgauuucaauaagcaggccauacagcggcugaaaacagaagcgcagaugucuauucaacucaucaacaaggcaguuaaugcccugaucaacgaccagcuuauuaugaagaaucaucugcgcgauaucaugggcauuccauauugcaacuacuccaaauauugguacuugaaucacaccagcacggggcgaaccucgcuccccaaguguuggcuggugucuaacggauccuacuuaaaugagacacacuuuucagacgacauagagcagcaagcugauaacaugaucacugaaaugcugcagaaagaguauauugacagacaggguaagaccccucuaggccucgucgauguguucauguuuaguacuagcuucuaccugaucuccaucuuucuucacuugguaaaaauuccaacacauaggcacauaguugggaagucuugccccaaaccucaucggcugaaucacaugggaaucuguagcugcggccucuauaagcagccaggugugccgguccguuggaagcgcuga

SEQ ID NO: 1684 - RNA, 1473 nt, Artificial Sequence
  derived and/or modified CDS sequence (opt3) from Lassa virus__ANH09740__GPC
augggccagaucgugaccuucuuucaagaggucccccacguuauugaagaggugaugaacauaguacugaucgcccucagccuucuggcuauuuugaagggguuauacaauuucgcaacaugcggagugaucggucugauuacuuuucuacuccuguguggcagauccugcucugccacguauaaagggcaguacgaacuucagacccuggaguugaacauggaaucacucaauaugacaaugccucugaguuguacuaagaacaauagccaucacuauaucagggcgggaaacaauaccggccuggagcucacauuaaccaacacuuccauaaucucucauaaauucugcaaucugucggacgcucacaagaaaaaccuuuacgaucauacauugaugucaauuaucaccacguuucaccugagcauuccaaauuucaaccaguaugaggccaugaguugugacuuuaauggugggaagaucuccauacaauacaaccuaucucacagcuaugcaggagaugccgcucagcauugcggcacugucgcaaauggcgugcuccagaccuucaugcggauggccuggggaggguccuaccuggcucuugacucaggucgccgaggcugggauuguauuaucaguagcuaccaguaucugauuauccaaaacacaacuugggacgaucacugccaguuuucucguccgucccccaucggguacuugggauucguuucacagaagaccagagacauuuauauaagcaggcggcuccugggcacauuuaccuggacguuaagugauucugaaggucaugacaugccugggggauacugucugacucgcuggaugcucaucgaggccgaucuuaaaugcuucggcaacacagcgguggcaaaguguaaugaaaaacacgacgaggaguuuugcgauauguggagacuguucgacuucaacaagcaggccauucaaagguugaaagcugaagcccagaugaauauccagcuaauaaacaaggcagucaaugcucugauuaacgaccaacucaugaugaagaaucaucugcgggauaucaugggcaucccauauugcaacuacuccaaauuuugguaucuuaauaacaccacuacagggcgcaccagccugccccgauguugguugauuucgaauggaucuuaccucaacgagacgcacuucuccgacgauaucgaacagcaggccgacaauaugauuaccgagaugcugcagaaggaauacauggauagacaagguaaaacaccuuuaggccugguggaccuauuuguauucucaaccaguuuuuaucucauaacuaucuuccugcaccuuguuaagauuccaacacauaggcacaucguggggaaacccugcccuaagccacaucgguugaaccacaugggaaucuguagcugcggccuguacaaacagccggguguccccgugcguuggaagcgcuga

SEQ ID NO: 1685 - RNA, 1473 nt, Artificial Sequence
  derived and/or modified CDS sequence (opt3) from Lassa virus__CAA36645__GPC
augggccagaucgugaccuucuuucaagaggucccccacguuauugaagaggugaugaacauaguacugaucgcccucagcauucuugcuauccugaagggguuguacaauguggcaacaugcggauuaauuggucuggucacuuuccuacuccuguccggcagaucuuguucacuuaucuauaaagggacguacgaacugcagaccuuggagcucaacauggaaacacugaauaugacuaugccucugaguugcaccaagaacaauagccaucacuauauaagggugggaaacgagacaggccucgaguuaacccugacuaauacauccauccuuaaccauaaauuuuguaauuugucugacgcccacaagcggaaccuguacgaucauucgcuaaugucaauuaucagcaccuuccaccucaguauuccaaauuuuaaccaguaugaagcgauguccugcgacuucaauggugggaaaaucacgguucaguacaaccugucucacagcuuugcuguggaugccgcaggacauuguggcacucuugccaauggcguccugcaaaccuucaugcgcauggcuuggggaggguccuauauagcauuggacucaggucgaggcaacugggauugcauuaugacaaguuaccaguaccucaucauucagaacacuaccugggacgaucacugucaguuuagccguccgucucccaucggguaucugggauuacugucccaaagaacaagggacaucuacauuucacggcgccuccuuggcaccuucacguggacucugagcgauagugaggguaaugaaacaccugggggauauugcuugaccagauggaugcuaauagaggccgagcugaaguguuuuggcaacacugcuguggccaagugcaaugaaaaacaugacgaggaguucugugauaugcucaggcuguuugacuucaacaagcaggcgauccggcgccuuaaaacagaagcacagaugucuauucagcugaucaauaaggccguaaacgcuuugauaaaugaucaacucauuaugaaaaaccaucugcgagacaucaugggcaucccauacugcaauuauuccagauacugguauuuaaaccacaccagcacggggaagaccucgcugcccaggugcuggcuaauuucuaauggauccuaccucaacgaaacaaaguucucagacgauaucgagcagcaggccgacaauaugauuacugagaugcugcaaaaagaauacauagaucggcaggguaagaccccucuuggcuugguugaccuguuuguguucaguacuagcuuuuaucucaucuccauuuuccugcaccuugucaaaaucccaacacaccgucauaucguggggaagcccuguccuaaaccacaccgccugaaccauaugggaauuugcucuuguggcuuguacaagcagccgggugugcccgucagauggaaaagguga

SEQ ID NO: 1686 - RNA, 1476 nt, Artificial Sequence; identical to SEQ ID NO: 1506
  derived and/or modified CDS sequence (opt3) from Lassa virus__NP_694870__GPC

SEQ ID NO: 1687 - RNA, 1713 nt, Artificial Sequence
  derived and/or modified CDS sequence (opt3) from Lassa virus__AAA46284__NP
augagcgccuccaaggaggugagaucuugccuguggacccagucacucaggcgggaacuuaguggcuacuguagcaacaucaaacugcaagucguuaaggacgcucaggcauuguuacacgggcuggauuucuccgaggugucuaauguacagcgccuaaugcgaaaacagaagcgugacgauggagaccucaaaagacugagggaucuuaaccaagccgugaauaaccuggucgaauugaagucgacacagcagaagucagugcuccggguugguacucugagcagugacgaucugcucauuuuagcggcugaccuggagaaacuuaaguccaaagugacgcgcaccgaaagacccuugucuagcggcgucuauauggggaaucuguccucacagcaacuagaucagaggcgggcccuccugaacaugauaggaaugacaggcgugaguggugggggaaagggcgcaagcaauggcaucguacgcguuugggacgugaaaaacgccgagcuucugaauaaccaguuugggacuaugccuucuuugacccucgcuugccugacaaagcagggacaagucgauuuaaaugacgcagugcaggcccugaccgaucucggucuuauuuacacugcuaaguauccaaacuccucagaccuggaccgauugagccagagucauccgauccuaaauaugauugauaccaaaaagucuucccugaacaucagcggcuacaauuucucgcucggggccgcggugaaagcaggagccuguaugcuggacggcgguaacaugcuugagacaauaaaggucucuccccaaacgauggaugggauccugaaauccauuuugaagguuaaaaagucacucggaauguuugugagugacacuccuggcgaaagaaacccauaugagaauauccuguacaagauuugcuuaagcggcgaugggugguccuauaucgcuucuaggaccagcauaguaggacgggccugggaaaacacaguggucgaccuggagcaggauaauaaaccccagaagauugguaacggcgggucaaauaaaagucuacaguccgcaggauucgcugccggccucaucuacagccaacugaugacucuuaaggacuuuaaauguuucaacuugauuccuaaugcgaagaccuggauggauaucgagggucguccagaagaccccguggagaucgcccuguaccagccuucuucagggugcuauguucacuuuuuccgcgaaccaacagaucucaagcaguuuaaacaggacgcaaaguacagucauggcagagacgugaccgaucuguucgcugcccaaccgggacuuacgagcgcugucauugaggcccugcccaggaacauggugauaacuugucagggcuccgaagacauccggaaauugcucgagucucaggggcgacgcgauauuaagcugaucgacauaacauuaucgaaagcagauagcagaaaguuugagaaugccguaugggaccaguucaaggaucugugccacaugcauaccggaguuguggucgagaaaaagaaaagggguggcaaggaagaaauuacuccucacugugcucuaauggacugcaucauguuugaugcggcaguguccgggggacucgacgccaaaguccugcgggugguucuuccacgcgauaugguguucagaacaucaacccccaagguagucuuguga

SEQ ID NO: 1688 - RNA, 1710 nt, Artificial Sequence
  derived and/or modified CDS sequence (opt3) from Lassa virus__AAF86704__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugaauaacguacagcggcuaaugcgcaagcagaaacgagacgauggagaccucaagcgucugagagaucuuaaucaagccgugaacaaucuggucgaauugaagucuacacagcagaaaucgauucucaggguggguacucugacgucagacgaucugcucaccuuagcggcugaccuggagaaacuuaagagcaagguuauacggacagaacgccccuugaguuccggcguguauauggggaaccugucuacucagcaacuagagcagagaagggcccuccugaauaugaucggaauggucggcggugcacaggggacccagccuggacgggauggcgugguacgcguuugggacgugaaaaacccagaucuucugaauaaccaauucggcacaaugccgagcuugacccucgccugucugacuaagcaggggcaggucgacuuaaaugaugcugugcuggcacucacagaccuuggacugauuuacaccgccaaguaucccaacuccucagacuuggaucgacuaagucaaagccauccuauccugaauaugguggacacgaaaaagucuucccucaacauuucagguuacaauuuuagccugggcgcugccgucaaagcgggggcaugcaugcuugauggaggcaacaugcuggagacuaucaagguuaccccacagacaauggacgguauauugaaaaguauccucaaggugaaaagaucucuggggauguucguauccgauacucccggagaaaggaacccuuaugagaauauuuuauacaagaucugucugagcggcgacggcuggccauauauugccucgcggaccucuaucguggggcgugcuugggaaaacacaaccgucgaucuagaguccgacggaaagccccagaaaguggguacggccggcucaaauaagagucuccagagcgcaggguuuccuacuggacugacauacucccaacuuaugaccuugaaagauucuaugaugcagcuggacccaagcgcuaagacuuggauagauauugagggccgcccggaagaccccguugagaucgcccucuaccagccuaugucagguugcuauauucacuucuuuagagaaccaacagaccugaaacaguucaagcaagaugcgaaguacagucaugggaucgacguggccgaucuuuuucccgcacagccuggccugaccuccgcugucaucgaggccuugccaaggaacauggugcucacgugucagggaagcgacgauauuaaaaagcuguuagacucucagggccggcgagauauaaaacugaucgacauuucacuaaguaagguagauagccgcaaauucgaaaaugcuguuugggaccaaugcaaggaucucugucacaugcauaccgggguggucguggagaagaaaaagagaggagguaaagaggaaaucacaccccacugcgcccugauggacuguauaauguuugaugcagccgucuccggcgggcuuaacauuccgguguugagggcuguucugccucgggacaugguguuccgcacuucuucgcccaagguaguccucuga

SEQ ID NO: 1689 - RNA, 1710 nt, Artificial Sequence
  derived and/or modified CDS sequence (opt3) from Lassa virus__AAO59513__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaaggaacgacgugacgauucggaccucaaaagacugagggaucuuaaccaggccgugaauaaccuggucgaguugaagucaacacaacagaaaagcgugcuccggguuggaacucugacgagugacgaucugcucguguuagcggcugaccuggaaaaacuucgcuccaaggucaccagaacagagaggcccuugucugccgguguguauaugggcaaucugagcucccagcagcuagaucaacggcgcgcacuccugucaaugauugggaugaacggaaguaaucagggcgcccgagcugguagagacgggguaguuagggugugggaugucaaaaacgcagagcuucugaauaaccaguucggaacuaugccuagcuugacccucgccugucugacaaagcagggccaaguggacuuaaaugaugcugugcaggcccugaccgaccucggccuuauauacacugcgaaauauccaaacacaucugaccuggaucgguugacccagucccauccgauccuaaauaugauugacacgaagaagucaagccugaacgucaguggguacaauuuuucucucggagcagccguuaaagcuggugccugcaugcuggauggcgggaacaugcuugaaacuaucaaggugagcccccaaaccauggacggcauucugaaauccaucuugaagguaaagaaggcacucggaauguucauaucggauacaccuggugagcguaacccauaugaaaauauccuguacaaaauuuguuuaucuggggacggauggcccuauaucgcuucccgcacuucaauuaccggcagagccugggagaacacaguggucgaucuggagagugacgaaaagccucagaaggcgggcagcaauaacuccaauaaaucucuacagagcgccggguuuaccgcaggacucacguacucacagcugaugacucuuaaggaugcuauguugcaacuggacccaaacgccaaaacauggauggauaucgaggguaggcccgaagacccuguggagauagcucucuaccagccaaguuccggcugcuauauucacuucuuucgggaaccgaccgaccugaagcaguucaaacaggaugccaaguacagccaugggaucgacauuacugaucuuuuugcagcccaacccggacugacaucugcuguuaucgacgcguugccucgaaauauggugaucaccugucagggcucagaugacauucgcaagcuccuggagagucaggguagaaaagauauaaaguuaaucgacauugcacugaacaaagccgauagcaggaaguaugagaaugcugucugggaccaguacaaagaucuaugccacaugcauacgggggugguaguugaaaagaagaaacggggcggaaaggaggaaaucaccccacacugugcccucauggacugcauaauguucgaugcagccguguccggcgggcugaaaacacuugucuugcgcgcugugcugcccagagacauggucuuuaggacuucuaccccucgugugguucucuga

SEQ ID NO: 1690 - RNA, 1710 nt, Artificial Sequence
  derived and/or modified CDS sequence (opt3) from Lassa virus__AAT48999__NP
augagcguguccaaggagaucaaaucuuuccuguggacccagucacucagaagggaacuuaguggcuacugcagcaacauuaagcugcaagucguuaaagacgcccaggcuuuguuacacgggcuggauuuuuccgaggugucuaauguacagcggcuaaugcgcaagcagcgacgugacgauaacgaccucaaaagacugagggaucuuaaucaagcagugaacaaucuggucgaauugaagucgacacagcagaagucagugcuccggguuggaacucugacgagcgacgaucugcucauauuagccgcggaccuggagaaacuuaagaguaaagugacccgcacagaaagacccuuguccgcuggugucuauaugggcaaccugucuagccagcaacuagaucagaggcgggcccuccugaauaugaucgggauguccggaggcaaccagggugcacagacugggcgcgacggagugguacgaauuugggauguuaagaaugccgagcuucugaacaaucaauucggcaccaugccuucauugacacucgcuugucugaccaaacagggccagguggacuuaaacgaugucgugcaagcacugacugaccucgggcuuaucuacacagccaaguauccaaauaccagugaccuggauagauugacgcagagccauccgauucuaaacaugaucgacacuaagaaaucuucccugaauauaucaggauacaacuuuagccucggugcugccgugaaggcgggcgcaugcaugcuggaugggggaaacaugcuugagaccaucaaagucaguccccagacaauggacggcauucugaagucuaucuugaaaguuaagaaagcccucgguauguucauuuccgauacuccuggggaaaggaauccauaugagaacauccuguacaagauauguuuaagcggagacggcuggcccuauauugcuucgcggaccucuaucacaggccgugccugggaaaauaccgugguagaucuggaguccggggagaagccucagaaaauuggaucaaacaauaguaacaagugccuacaaagcgcagguuuuacggcuggccucuccuacucucagcugaugacucuuaaagacgccauguugcagcuggauccaaaugcgaagacauggauggacaucgaagggcgccccgaggauccuguggaaaucgcccucuaccagccaagcucaggauguuauauucacuucuuuagagagccgaccgaccugaaacaauucaagcaggacgcaaaguacagucauggcauagaugucacugaccuuuuugcugcccagcccggucugacauccgcugugaucgaagccuugccuaggaacaugguuaugaccugccaggggagcgaugacauucggaaacuccuggagucucaaggccgaaaggauaucaaauuaauagacauugcacugucaaagacggauagucgcaaauaugagaaugccgugugggaccaguacaaggaucuaugucacaugcauaccggagucgugguagaaaagaaaaagaaaggcgggaaggaggaaaucacaccacacugcgcucucauggacuguaucauguucgaugcggcaguuagcggaggucugaacacuuccgugcuuagagccgucuugcccagggacaugguguuucggaccucuacaccuaaagucgugcuguga

SEQ ID NO: 1691 - RNA, 1710 nt, Artificial Sequence
  derived and/or modified CDS sequence (opt3) from Lassa virus__AAT49007__NP
augagcguguccaaggagaucaaaucuuuccuguggacccagucacucagaagggaacuuaguggcuacugcagcaacauuaagcugcaagucguuaaagacgcccaggcuuuguuacacgggcuggauuuuuccgaggugucuaauguacagcggcuaaugcgcaagcagcgacgugacgauaacgaccucaaaagacugagggaucuuaaucaagcagugaacaaucuggucgaauugaagucgacacagcagaagucagugcuccggguuggaacucugacgagcgacgaucugcucauauuagccgcggaccuggagaaacuuaagaguaaagugacccgcacagaaagacccuuguccgcugguaucuauaugggcaaccugucuagccagcaacuagaucagaggcgggcccuccugaauaugauugggauguccggaggcaaccagggugcacagacugggcgcgacggagucgugcgaaucugggauguaaagaaugccgagcuucugaacaaucaauucggcaccaugccuucauugacacucgcuugucugaccaaacagggccagguugacuuaaacgaugugguccaagcacugacugaccucgggcuuauuuacacagccaaguauccaaauaccagugaccuggauagauugacgcagagccauccgauccuaaacaugauagacacuaagaaaucuucccugaauaucucaggauacaacuuuagccucggugcugccgugaaggcgggcgcaugcaugcuggaugggggaaacaugcuugagaccauuaaagugaguccccagacaauggacggcauccugaagucuauuuugaaagucaagaaagcccucgguauguucaucuccgauacuccuggggaaaggaauccauaugagaacauacuguacaagauuuguuuaagcggagacggcuggcccuauaucgcuucgcggaccucuauuacaggccgugccugggaaaauaccguuguggaucuggaguccggggagaagccucagaaaaucggaucaaacaauaguaacaagagccuacaauccgcagguuuuacggcuggccucacuuacucucagcugaugacacuuaaagacgccauguugcagcuggauccaaaugcgaagaccuggauggacaucgaagggcgccccgaggauccuguagaaauugcccucuaccagccaagcucaggaugcuauauacacuucuuuagagagccgacugaccugaaacaauucaagcaggacgcaaaguacagucauggcaucgaugugacagaccuuuuugcugcccagcccggucugaccuccgcugucauugaagccuugccuaggaacauggugaugacgugucaggggagcgaugacauccggaaacuccuggagucucaaggccgaaaggauauaaaauuaauugacaucgcacugucaaagaccgauagucgcaaauaugagaaugccguuugggaccaguacaaggaucuaugccacaugcauacaggaguggucguggaaaagaaaaagaaaggcgggaaggaggaaaucacuccacacugugcucucauggacugcauuauguucgaugcggcagccagcggaggucugaacacccuuguauugagagcuguucugcccagggacaugguguuucggacauccacuccuaaagucgugcucuga

SEQ ID NO: 1692 - RNA, 1710 nt, Artificial Sequence
  derived and/or modified CDS sequence (opt3) from Lassa virus__AAT49009__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagcgacgugacgauggagaccucaaaagacugagggaucuuaaccaagccgugaauaaccuggucgaauugaagucgacacagcagaagucagugcuccggguugguacucugaauagcgacgaucugcucguguuagcggcugaccuggagaaacuuaagaguaaagucauucgcacggaaagacccuuguccucuggcauauauauggggaaccugagcucccagcaacuagaucagaggcgggcccuccugaauaugaucggaaugaccggcgguaaccgcgggggaggcacaucaagugacggcauugugcgaguaugggauguuaagaaugcagagcuucugaacaaucaguucgggacuaugccuagcuugacccucgccugucugacaaaacagggacaaguggacuuaaacgaugcuguccaggcacugaccgaccucggucuuaucuacacugccaaguauccaaauucuuccgaccuggauagauuggcucagucacauccgauucuaaacaugaucgacacaaagaaaagcagucugaauauaucuggcuacaacuuuucccucggggccgcggugaaggcaggagccugcaugcuggauggcgguaacaugcuugagaccaucaaagugagcccccaaacgauugacgggauccugaagacuauuuugaaagucaagaaaucgcucggaauguucaucucugauguuccuggcgaaaggaauccauaugagaacauacuguacaagauuuguuuauccggcgacggguggcccuauaucgcuucacggaccaguauugugggacgugccugggaaaauacaguaguggaucuggagagcgacaacaagccucagaaaacugguaauggcggguccaacaagucucuacagagcgcaggauuugcugccggccucaccuacucacagcugaugacacuuaaagauaguauguugcaacuggacccaaauuccaagaccuggauggauaucgagggucgccccgaagacccugucgagaucgcgcucuaccagccaaacagcgggugcuauauucacuucuuuagagaaccgacggaccugaaacaguucaagcaggaugccaaguacucucauggcauagacgugacugaucuuuuugcagcucaacccggacugacaucagccguuaucgaggcuuugccuaggaauauggugauuaccugucagggcagugaagacauccggaaacuccuggagagccaggggcgacgcgauauaaaguuaauugacaucucccugaacaaagccgauucuagaaaguucgagaaugcagucugggaccaguuuaaagaucuaugccacaugcauacuggagugguaguugaaaagaagaaaagggguggcaaggaggaaaucacaccacacugugcccucauggacugcauuauguucgaugcugcggugagcgggggacuggacgcaaaaguccuucgggccguguugccccgcgauauggucuuuagaaccucgacgccuaaggugguucuguga

SEQ ID NO: 1693 - RNA, 1710 nt, Artificial Sequence
  derived and/or modified CDS sequence (opt3) from Lassa virus__ADI39452__NP
augagcguguccaaggaggucaaaucuuuccuguggacccagucacucagaagggaacuuaguggcuacugcagcaacaucaagcugcaaguugugaaagacgcccaggcuuuguuacacgggcuggauuuuuccgagguaucuaaugugcagcggcuaaugcgcaagcagcgacgugacgauaacgaccucaaaagacugagggaucuuaaucaagcagucaacaaucugguggaauugaagucgacacagcagaagucaguucuccgggugggaacucugacgagcgacgaucugcucauuuuagccgcggaccuggagaaacuuaagaccaaagucacacgcacugaaagacccuugagugcugguguguauaugggcaaccuguccucucagcaacuagagcagaggcgggcccuccugaauaugauagggaugaacggaggcaaucaggguguacaggcagggcgcgauggaguugugcgagucugggacgugaagaacgccgagcuucugaauaaccaauucggcaccaugccuagcuugacacucgcuugucugaccaaacagggccagguggauuuaaaugacgcaguccaagcccugacugaucucgggcuuaucuacacagcuaaguauccaaacaccuccgaccuggacagauuggcccagucacauccgauucuaaauaugaucgauacgaagaaaaguagccugaacauuucuggauacaacuuuucccucggugcggcaguuaaggccggcgcuugcaugcuggacgggggaaauaugcuugaaacuaucaaagugucaccccagaccauggauggcauacugaaaagcaucuugaagguaaagaggacacucgguauguucgugagugacacuccuggggagcggaacccauaugaaaauauucuguacaaaaucuguuuaucuggagauggcuggcccuauauugccucccguaccagcaucacaggccgcgcaugggagaacaccauagucgaccuggagucggaugggaagccucagaaggugggaaauaacgguucuaauaaaucccuacaaucagcuggcuuuacggccgggcucacuuacagucagcugaugacacuuaaggacgcgauguugcagcuggauccaaacgccaaaaccuggauggacauugaaggaagacccgaggauccuguugaaguggcacucuaccagccaagcuccggcugcuauauccacuucuuuagggagccgacugaccugaagcaauucaaacaggacgcuaaguacucucaugguauugaugucacagaccuuuuugccgcucagcccgggcugaccagcgccgugaucgaagcauugccucggaauaugguaaucacgugucagggcucagaggauguucgaaagcuccuggagagucaaggacgcaaagacauuaaguuaauagauaucgcccuguccaaagcugacagcagaaaguaugaaaacgcggugugggaucaguacaaagaccuaugccacaugcauaccggcgucguggucgagaagaagaaaaggggagggaaggaagagaugacaccacacugugcacucauggauugcauuauguucgacgccgcugugucugguggccugucaacucagguucuucgggccguguugccccgcgauaugguauuuagaaccaguacaccuaaagucgugcuguga

SEQ ID NO: 1694 - RNA, 1710 nt, Artificial Sequence
  derived and/or modified CDS sequence (opt3) from Lassa virus__ADU56611__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucagugcucaggguugguacucugacgagcgacgaucugcucaccuuagcggcugaccuggagaaacuuaagaguaaggugauucggacagaacgccccuuguccucuggcgucuauauggggaaucugagcacucagcaacuagagcagagaaaagcccuccuguccaugauaggaauggugggcggugcacaggggacccagccuggaagggauggcguaguucgggugugggacgucaagaacccagaucuucugaauaaccaauucggcacaaugccgucauugacccucgccugucugacuaagcagggacagguggacuuaaaugaugcugugcuggcacucacagaccuugggcugaucuacaccgccaaauaucccaacaguagcgacuuggaucgccuaucucaaucccauccuauucugaauauggucgacacgaagaaaucaagccucaacaucagugguuacaauuuuucucugggcgcugccguuaaggcgggggcaugcaugcuugauggaggcaacaugcuggagacuauuaaagugaccccacagacaauggacgguaucuugaaguccauacucaaaguaaagcgaagccuggggauguucgugucggauacucccggagaaagaaauccuuaugagaacaucuuauacaagauuugucugucuggcgacggcuggccauauaucgccuccaggaccucaauugucgggcgggcuugggaaaacacaaccguggaucuagagagugacggaaaaccccagaagguugguacggccggcagcaauaaaucccuccagucugcaggguuuccuacuggacugacauacagccaacuuaugaccuugaaggauucaaugaugcagcuggacccaagugcuaaaacuuggaucgauauagagggccguccggaagaccccguggagauugcccucuaccagccuauguccgguugcuauauccacuucuuucgcgaaccaacagaccugaagcaguucaagcaagaugcgaaauacagccaugggauugacgucaccgaucuguuuucugcccagcccggccuuacgucagcagugaucgaggcuuugccuagaaacaugguacucaccugucagggaagugacgauaucaagaaacuguuagacagccagggcaggcgggauauuaagcugauagacaucucccuaaauaaagccgauucucgacgcuucgaaaacgcuguuugggaccaaugcaaggaucucugucacaugcauacagggguggucguggagaagaaaaagagaggagguaaagaggaaauuacuccacacugcgcccugauggacuguaucauguuugaugcagccgucucgggcgggcuuaauauacccauuuugagggcugugcugccgcgggacaugguuuuccgcaccagcuccccuaaggugguacucuga

SEQ ID NO: 1695 - RNA, 1710 nt, Artificial Sequence
  derived and/or modified CDS sequence (opt3) from Lassa virus__ADU56615__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcgugcucaggauuggaacucugaguuccgacgaucugcucauauuagcggcugaccuggagaaacuuaagucuaagguugugcggacggaacgccccuugagcuccgguaucuauaugggcaaucugucaagucagcaacuagaucagagaaaagcccuccugaacaugauugggaugaccggaggcaauggugggaggaacgcaacaagcgacggaaucguccgggugugggauguaaagaaugccgagcuucugaacaaucaguucggcacuaugccuucuuugacccucgcuugucugacaaagcagggccaaguugacuuaaacgaugcagugcaggcccugaccgaccucgggcuuauuuacacugcuaaauauccaaauuccucagaccuggaucgcuuggcccagagccauccgauccuaaacaugauagacacaaagaaaaguucucugaauaucuccggauacaacuuuagccucggugcggcagucaaggccggcgcuugcaugcuggaugggggaaacaugcuugagaccauuaaagugucgccccaaacgauggacggcauccugaagucuauuuugaaagugaagcgaucccucgguauguucaucucagauacuccuggggaaagaaauccauaugagaacauacuguacaagauuuguuuaaguggagacggcuggcccuauaucgccagcaggaccuccauugucggccgggcaugggaaaauacaguuguggaucuggagacugacaacaaaccucagaagaccgggaauggagguucuaacaaaagccuacagucagcuggcuuugccgcggggcucacauacagucagcugaugacccuuaaggauuccauguugcaacuggacccaaaugccaaaacguggauggauaucgagggacgucccgaagacccuguagagaucgcacucuaccagccagugagcggcugcuauauucacuucuuucgcgaaccgacugaccugaagcaguucaagcaggaugcuaaauacucucaugguauagacgucacagaucuuuuugccgcucaacccgggcugaccucagccgugaucgaggcauugccuagaaacaugguuauuacuugucagggcagugaagacaucaggaagcuccuggagagccagggacggcgagauauaaaauuaauugacaucucccugucuaagguggauucgcgcaaauucgagaaugccgucugggaccaguuuaaggaucuaugccacaugcauacaggcaucgugguagaaaagaaaaagagagggggaaaagaggaaauuaccccacacugugcucucauggacugcaucauguucgaugcggcaguuagcgguggcguggacgccaagguccugagggcugugcuuccccgggauauggucuuucgcacguccaccccuaaagugguuuuguga

SEQ ID NO: 1696 - RNA, 1710 nt, Artificial Sequence
  derived and/or modified CDS sequence (opt3) from Lassa virus__ADU56619__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucagugcucaggguugguacucugagcagugacgaucugcucguguuagcggcugaccuggagaaacuuaaguccaaggucgugcggacggaacgccccuugucuagcggcauuuauauggggaaucuguccucacagcaacuagaucagagaaaagcccuccugaacaugauaggaaugaccggcgguaaugggggaaggaacacaaccagugacggcaucguacggguuugggaugugaagaaugcagagcuucugaacaaucaguucggcacuaugccuagcuugacacucgccugucugaccaagcaggggcaagucgacuuaaacgaugcugugcaggcacugacugaccucggacuuauuuacacagccaaauauccaaauucuuccgaccuggaucgcuuggcucagucacauccgauccuaaacaugauugacaccaagaaaagcagucugaauaucucugguuacaacuuuucccucggcgccgcggugaaggcaggggccugcaugcuggauggaggcaacaugcuugagacgauaaaagucagcccccaaacuauggacgguauccugaagucgauuuugaaaguuaagcgaucucucgggauguucaucuccgauaccccuggagaaagaaauccauaugagaacauucuguacaagaucuguuuaucaggcgacggcuggcccuauauagcuaguaggacaagcauuguggggcgggccugggaaaauacuguaguggaucuggaguccgacaacaaaccucagaagaccggaaaugguggcucuaacaaaagccuacagucagcaggguuugcugccggacucacauacagucagcugaugacccuuaaggauuccauguugcaacuggacccaaaugcgaaaacguggauggauaucgagggccgucccgaagacccugucgagauugcccucuaccagccaagcucugguugcuauauccacuucuuucgcgaaccgacugaccugaagcaguucaagcaggaugcaaaauacucacaugggaucgacgugacagaucuuuuugcugcccaacccggccugaccagugcuguuauugaggccuugccuagaaacauggugauaacuugucagggaagcgaagacaucaggaagcuccuggagucccagggccggcgagauauuaaauuaaucgacauaucucugucgaaggucgauagccgcaaauucgagaaugcagugugggaccaguuuaaggaucuaugccacaugcauacagggauuguaguugaaaagaaaaagagaggagguaaagaggaaaucaccccacacugugcccucauggacugcaucauguucgaugcugcgguguccggcggggucgacgcaaaggugcugagggccguccuuccccgggauaugguguuucgcacgucaaccccuaaaguuguguuguga

SEQ ID NO: 1697 - RNA, 1710 nt, Artificial Sequence
  derived and/or modified CDS sequence (opt3) from Lassa virus__ADU56623__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaaccuuaucgggauggucggaggcgcacaggguacccagccugggcgggauggagugguacgcguuugggacgugaaaaauccagaucuguugaacaaucaauucggcacaaugccgucacucacccuggccuguuuaacuaagcagggccaggucgaccugaacgaugcugugcucgcacuuacagaccugggguugauuuacaccgccaaguaucccaauaguagcgaccuagaucgacugucucaaucccauccuauccucaacaugguggacacgaaaaagucaagccugaauauuaguggauuuaacuucucucuuggugcugccgucaaagcgggcgcaugcaugcuggaugggggaaauauguuggagacuaucaagguuaccccacagacaauggacggcauacucaaauccauccugaaggugaaaaagagcuuagguauguuuguaucggauacucccggggaaagaaacccuuacgagaacauucuguauaagaucugucuaucuggagacggcuggccauacauugccuccaggaccucaaucgugggccgggcuugggaaaauacaaccgucgaucucgagagugacgggaaaccccacaaggugggaacggccgguagcaacaaaucccugcagucugcaggcuucccuacugggcuuacauauagccaguugaugacccugaaggauucaaugaugcaacucgacccaagugcuaaaacuuggauagauauugagggacguccggaagaccccguugagaucgcccuguaccagccuauguccggcugcuacauucacuuuuuccgcgaaccaacagaccuuaagcaguuuaagcaggaugcgaaauauagccaugguaucgacguggccgaucuguuccccgcacaaccuggguugaccucugcugucaucgaggcccucccaagaaauauggugcugacgugucagggcucagacgauauuaagagguuacuggacagucagggacggcgagauauaaaacuaaucgacauugcucucagcaaggccgauucccgcagauuugaaaacgcaguaugggaccagugcaaagaucugugucauaugcacaccggcguuguggucgagaagaagaaaaggggagggaaggaggaaaucacaccccacugcgcccuuauggacuguauaauguacgaugcugcggugucugguggcuugaauauuccgguccugcgggcagugcucccucgcgacaugguuuucagaacuucgagccccaaagugguacuguga

SEQ ID NO: 1698 - RNA, 1710 nt, Artificial Sequence
  derived and/or modified CDS sequence (opt3) from Lassa virus__ADU56627__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucugaacacucagcaacuagagcagagaagggcccuccugaauaugaucgggauggcaggaggcgcccaggguacccagccugggcgggauggagucgugcgcguaugggacguuaaaaacccagaucuucugaauaaccaauucggcacaaugccguccuugacccucgcuugucugacuaagcagggccagguggacuuaaaugaugcaguccuggcccucacagaccuugggcugauuuacaccgcuaaguaucccaacucaagugacuuggaucgacuaagccaaucucauccuauccugaauaugguggacacgaaaaaguccucacucaacauuagcggauacaauuuuagucugggugccgcggugaaagcaggcgccugcaugcuugaugggggaaacaugcuggagacuaucaaggucaccccacagacaauggacggcauauugaaaucuauccucaagguuaaaaagucccuggguauguucgugagcgauacucccggggaaagaaacccuuaugagaauauuuuauacaagaucugucugucgggagacggcuggccauauauugcuucuaggaccuccaucguaggccgggccugggaaaacacaaccguggaucuagagucagacgggaaaccccagaaggucggaacggcagguaguaauaaaagccuccaguccgcuggcuuuccuacugggcugacauacucucaacuuaugaccuugaaggauagcaugaugcagcuggacccaucagccaaaacuuggauagauauugagggacguccggaagaccccguggagaucgcgcucuaccagccuaugaguggcugcuauauucacuucuuucgcgaaccaacagaccugaagcaguucaagcaagaugccaaauacucccaugguaucgacguugcagaucuuuuucccgcucagccugggcugaccagcgccgugaucgaggcuuugccaagaaacaugguccucacgugucagggcucugacgauauuaagaggcuguuagacucacagggacggcgagauauaaaacugaucgacauugcccuaaguaaggcagauagccgcagauucgaaaaugccgugugggaccaaugcaaagaucucugucacaugcauaccggcguaguuguggagaagaagaaaaggggagggaaggaggaaaucacaccccacugcgcucugauggacuguauaauguaugaugcggcagucuccgguggccuuaacauuccgguguugcgggccguccugccucgcgacaugguguuuagaacuucuucgcccaaaguugugcucuga

SEQ ID NO: 1699 - RNA, 1710 nt, Artificial Sequence
  derived and/or modified CDS sequence (opt3) from Lassa virus__ADU56631__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacacgaaaaagucaagccucaauauuaguggauacaacuuuucucugggugcugccgucaaagcgggcgcaugcaugcuugaugggggaaauaugcuggagacuaucaagguuaccccacagacaauggacggcauauugaaauccauccucaaggugaaaaagagccuggguauguucguaucggauacucccggggaaagaaacccuuaugagaacauuuuauacaagaucugucugucuggagacggcuggccauauauugccuccaggaccucaaucgugggccgggcuugggaaaauacaaccgucgaucuagagagugacgggaaaccccagaaggugggaacggccgguagcaacaaaucccuccagucugcaggcuuuccuacugggcugacauacagccaacuuaugaccuugaaggauucaaugaugcagcuggacccaagugcuaaaacuuggauagauauugagggacguccggaagaccccguugagaucgcccucuaccagccuauguccggcugcuauauucacuucuuucgcgaaccaacagaccugaagcaguucaagcaagaugcgaaauacagccaugguaucgacgugaccgaucuuuuucccgcccagccugggcugacgucugcagucaucgaggcuuugccaagaaauauggugcucaccugucagggcucagacgauauuaagaggcuguuagacagucagggacggcgagauauaaaacugaucgacauugcccuaagcaaggcugauucccgcagauucgaaaacgccguaugggaccaaugcaaagaucucugucacaugcauacaggcguuguggucgagaagaagaaaaggggagggaaggaggaaaucacuccccacugcgcacugauggacuguauaauguaugaugccgcugugucugguggccuuaauauuccggucuugcgggcggugcugccucgcgacaugguuuuuagaaccucgagccccaaagugguacucuga

SEQ ID NO: 1700 - RNA, 1710 nt, Artificial Sequence
  derived and/or modified CDS sequence (opt3) from Lassa virus__AFY05580__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuucgcaguaaggugauuagaaccgagaggcccuuguccgccgguguuuauaugggcaaccugucuagccagcagcuagaucaacggcgcgcacuccugaauaugaucgggauguccggaggcaaccagggugcccgagcugggagagacggaguggucagggugugggauguuaaaaaugcagagcuucugucaaaccaguucggcacaauuccuaguuugacucucgccugucugaccaagcagggccaaguagacuuaaaugaugcugugcaggcccugacagaccucgggcuuaucuacaccgcgaaauauccaaacacuagcgaccuggaucgguugacacagucucauccgauacuaaauaugaucgacaccaagaaguccucacugaacauuagcggauacaauuuuagucucggugcagccgucaaagcuggcgccugcaugcuggaugggggaaacaugcuugaaacgaucaaggugucuccccaaacuauggacggcauucugaaauccaucuugaaggugaaaaaggcacucgguauguucauaagcgauaccccuggggagcguaacccauaugaaaauauucuguacaaaaucuguuuaucgggagacggcuggcccuauauugcuucucgcacauccaucacuggcagagccugggagaacaccgucguugaucuggagucagggggaaagccucagaaggcggacaguaauaacagcuccaaaucucuacagagcgccgguuuuacagcaggccucaccuacucacagcugaugacgcuuaaggaugcuauguugcaacuggacccaaaugccaaaacuuggauggauaucgaagggaggcccgaggacccuguggaaauugcucucuaccagccaaguuccggaugcuauauacacuucuuucgggagccgacagaccugaagcaguucaaacaggaugccaaguacagccauggcaucgacguaaccgaucuuuuugcaacucaacccggucugacaucugccgugauugacgcuuugccucgaaacauggucaucaccugucaggggucagaugacauacgcaagcuccuggaaagucagggcagaaaagauauuaaguuaaucgacaucgaucugagcaaaacggacuccaggaaguaugagaaugcggugugggaucaguacaaagaccuaugccacaugcauaccggaguuguggucgagaagaagaaacggggcgggaaggaagagauuacaccacacugugcacucauggauugcaucauguucgacgccgcugugucuggaggucugaacacuucgguacuucgcgccguuuugcccagagacaugguguuuaggaccagcacaccucgugucgugcuguga

SEQ ID NO: 1701 - RNA, 1710 nt, Artificial Sequence
  derived and/or modified CDS sequence (opt3) from Lassa virus__AFY05581__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccugaauaugaucgggauguccggaggcaaccagggugcccgcgcugggcgagacggaguggucagagugugggauguaaagaaugcagagcuucugucaaaccaguucggcacaauuccuaguuugacucucgccugucugaccaaacagggccaaguugacuuaaaugaugcugugcaggcccugacagaccucgggcuuaucuacaccgcgaaguauccaaacacuagcgaccuggauagguugacacagucucauccgauacuaaauaugaucgacaccaagaaauccucacugaacauuagcggauacaauuuuagucucggugcagccgucaaggcuggcgccugcaugcuggaugggggaaacaugcuugaaacgaucaaagugucuccccaaacuauggacggcauucugaaguccaucuugaaagugaagaaagcacucgguauguucauaagcgauaccccuggggagcggaacccauaugaaaauauucuguacaagaucuguuuaucgggagacggcuggcccuauauugcuucucguacauccaucacuggccgcgccugggagaacaccgucguugaucuggagucagggggaaagccucagaaagcggacaguaauaacagcuccaagucucuacagagcgccgguuuuacagcaggccucaccuacucacagcugaugacgcuuaaagaugcuauguugcaacuggacccaaaugccaagacuuggauggauaucgaagggagacccgaggacccuguggaaauugcucucuaccagccaaguuccggaugcuauauacacuucuuuagggagccgacagaccugaaacaguucaagcaggaugccaaguacagccauggcaucgacguaaccgaucuuuuugcaacucaacccggucugacaucugccgugauugacgcuuugccucggaacauggucaucaccugucaggggucagaugacauacgaaaacuccuggaaagucagggccgcaaggauauuaaauuaaucgacaucgaucugagcaagacggacuccagaaaauaugagaaugcggugugggaucaguacaaggaccuaugccacaugcauaccggaguuguggucgagaagaaaaagaggggcgggaaagaagagauuacaccacacugugcacucauggauugcaucauguucgacgccgcugugucuggaggucugaacacuucgguacuuaaggccguuuugccccgggacaugguguuucgcaccagcacaccuagagucgugcuguga

SEQ ID NO: 1702 - RNA, 1710 nt, Artificial Sequence
  derived and/or modified CDS sequence (opt3) from Lassa virus__AFY05587__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuucgcaguaaggugauuagaaccgagaggcccuuguccgccgguguuuauaugggcaaccugucuagccagcagcuagaucaacggcgcgcacuccugaauaugaucgggauguccggaggcaaccagggugcccgagcugggagagacggaguggucagggugugggauguuaaaaaugcagagcuucugucaaaccaguucggcacaaugccuaguuugacucucgccugucugaccaagcagggccaaguagacuuaaaugaugcugugcaggcccugacagaccucgggcuuauuuacaccgcgaaauauccaaacacuagcgaccuggaucgguugacacagucucauccgauccuaaauaugauagacaccaagaaguccucacugaacaucagcggauacaauuuuagucucggugcagccgucaaagcuggcgccugcaugcuggaugggggaaacaugcuugaaacgauuaaggugucuccccaaacuauggacggcauccugaaauccauuuugaaggugaaaaaggcacucgguauguucaucagcgauaccccuggggagcguaacccauaugaaaauauacuguacaaaauuuguuuaucgggagacggcuggcccuauaucgcuucucgcacauccauuacuggcagagccugggagaacaccgucguugaucuggagucagacgggaagccucagaaggcggauaguaauaacagcuccaaaucucuacagagcgccggauuuacagcaggucucaccuacucacagcugaugacgcuuaaggacgcuauguugcaacuggauccaaaugccaaaacuuggauggacaucgaaggcaggcccgaggacccuguggaaaucgcucucuaccagccaaguuccgggugcuauauucacuucuuucgggagccgacagaucugaagcaguucaaacaggacgccaaguacagccauggaauagauguaaccgaccuuuuugcaacucaacccggccugacaucugccgugaucgaugcuuugccucgaaacauggucauuaccugucaggguucagacgauauccgcaagcuccuggaaagucaggggagaaaagacauaaaguuaauugauaucgaccugagcaaaacggauuccaggaaguaugagaaugcggugugggaccaguacaaagaucuaugccacaugcauaccggcguuguggucgagaagaagaaacggggaggcaaggaagagaucacaccacacugugcacucauggacugcauuauguucgacgccgcugugucugggggacugaacacuucgguacuucgcgccguuuugcccagagauaugguguuuaggaccagcacaccucgugucgugcuguga

SEQ ID NO: 1703 - RNA, 1710 nt, Artificial Sequence
  derived and/or modified CDS sequence (opt3) from Lassa virus__AFY05591__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccugaauaugaucgggauguccggaggcaaccagggugcccgcgcugggcgagacggaguggucagagugugggauguaaagaauguugagcuucugucaaaccaguucggcacaaugccuaguuugacucucgcaugucugaccaaacagggccaaguggacuuaaaugaugccguccaggcucugacagaccucgggcuuauuuacaccgccaaguauccaaacacuagcgaccuggauagguuggcgcagucucauccgauccuaaauaugauagacacaaagaaauccucacugaacaucagcggauacaauuuuagucucggugcagccgugaaggcuggcgccugcaugcuggaugggggaaacaugcuugaaaccauuaaagugucuccccaaacgauggacggcauccugaaguccauuuugaaagucaagaaagcacucgguauguucaucagcgauacuccuggggagcggaacccauaugaaaauauacuguacaagauuuguuuaucgggagacggcuggcccuauaucgcuucucguaccuccauuacaggccgcgccugggagaacacuguuguggaucuggagucagacgggaagccucagaaagcggauaguaauaacagcuccaagucucuacagagcgccggauuuaccgcaggucucacauacucacagcugaugacccuuaaagacgcuauguugcaacuggauccaaaugccaagacguggauggacaucgaaggcagacccgaggacccuguagaaaucgcucucuaccagccaaguuccgggugcuauauucacuucuuuagggagccgacugaucugaaacaguucaagcaggacgccaaguacagccauggaauagaugugacagaccuuuuugcaacccaacccggccugacuucugccgucaucgaugcuuugccucggaacauggugauuacaugucaggguucagacgauauccgaaaacuccuggaaagucaggggcgcaaggacauaaaauuaauugauaucgaccugagcaagaccgauuccagaaaauaugagaaugcgguuugggaccaguacaaggaucuaugccacaugcauacgggcguggucguggagaagaaaaagaggggaggcaaagaagagaucaccccacacugugcacucauggacugcauuauguucgacgccgcuguaucugggggacugaacacaucgguucuucgggccguguugccccgcgauauggucuuuagaacuagcaccccuagggugguccuguga

SEQ ID NO: 1704 - RNA, 1710 nt, Artificial Sequence
  derived and/or modified CDS sequence (opt3) from Lassa virus__AFY05597__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccugaauaugaucgggauguccggaggcaaccagggugcccgcgcugggcgagacggaguggucagagugugggauguaaagaaugcagagcuucugucaaaccaguucggcacaaugccuaguuugacucucgccugucugaccaaacagggccaaguugacuuaaaugaugcugugcaggcccugacagaccucgggcuuauuuacaccgcgaaguauccaaacacuagcgaccuggauagguugacacagucucauccgauccuaaauaugauagacaccaagaaauccucacugaacaucagcggauacaauuuuagucucggugcagccgucaaggcuggcgccugcaugcuggaugggggaaacaugcuugaaacgauuaaagugucuccccaaacuauggacggcauccugaaguccauuuugaaagugaagaaagcacucgguauguucaucagcgauaccccuggggagcggaacccauaugaaaauauacuguacaagauuuguuuaucgggagacggcuggcccuauaucgcuucucguacauccauuacuggccgcgccugggagaacaccgucguugaucuggagucagacgggaagccucagaaagcggauaguaauaacagcuccaagucucuacagagcgccggauuuacagcaggucucaccuacucacagcugaugacgcuuaaagacgcuauguugcaacuggauccaaaugccaagacuuggauggacaucgaaggcagacccgaggacccuguggaaaucgcucucuaccagccaaguuccgggugcuauauucacuucuuuagggagccgacagaucugaaacaguucaagcaggacgccaaguacagccauggaauagauguaaccgaccuuuuugcaacucaacccggccugacaucugccgugaucgaugcuuugccucggaacauggucauuaccugucaggguucagacgauauccgaaaacuccuggaaagucaggggcgcaaggacauaaaauuaauugauaucgaccugagcaagacggauuccagaaaauaugagaaugcggugugggaccaguacaaggaucuaugccacaugcauaccggcguuguggucgagaagaaaaagaggggaggcaaagaagagaucacaccacacugugcacucauggacugcauuauguucgacgccgcugugucugggggacugaacacuucgguacuucgggccguuuugccccgcgauaugguguuuagaaccagcacaccuagggucgugcuguga

SEQ ID NO: 1705 - RNA, 1710 nt, Artificial Sequence
  derived and/or modified CDS sequence (opt3) from Lassa virus__AFY05610__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccugaauaugaucgggauguccggaggcaaccagggugcccgcgcugggcgagacggaguggucagagugugggauguaaagaaugcagagcuucugucaaaccaguucggcacaaugccuaguuugacucucgccugucugaccaaacagggccaaguugacuuaaaugaugcugugcaggcccugacagaccucgggcuuauuuacaccgcgaaguauccaaacacuagcgaccuggauagguugacacagucucauccgauccuaaauaugauagacaccaagaaauccucacugaacaucagcggauacaauuuuagucucggugcagccgucaaggcuggcgccugcaugcuggaugggggaaacaugcuugaaacgauuaaagugucuccccaaacuauggacggcauccugaaguccauuuugaaagugaagaaagcacucgguauguucaucagcgauaccccuggggagcggaacccauaugaaaauauacuguacaagauuuguuuaucgggagacggcuggcccuauaucgcuucucguacauccauuacuggccgcgccugggagaacaccgucguugaucuggagucagacgggaagccucagaaagcggauaguaauaacagcuccaagucucuacagagcgccggauuuacagcaggucucaccuacucacagcugaugacgcuuaaagacgcuauguugcaacuggauccaaauacuaagacauggauggacaucgaaggcagacccgaggacccuguggaaaucgcccucuaccagccaaguuccgggugcuauauucacuucuuuagggagccgaccgaucugaaacaguucaagcaggacgcuaaguacagccauggaauagauguaacugaccuuuuugccacacaacccggccugaccucugcagugaucgaugccuugccucggaacauggucauuacgugucaggguucagacgauauccgaaaacuccuggaaagucaggggcgcaaggacauaaaauuaauugauaucgaccugagcaagaccgauuccagaaaauaugagaaugcugugugggaccaguacaaggaucuaugccacaugcauacaggcguuguggucgagaagaaaaagaggggaggcaaagaagagaucacuccacacugugcgcucauggacugcauuauguucgacgcagccgugucugggggacugaacaccucgguacuucgggcuguuuugccccgcgauaugguguuuagaacaagcacuccuagggucgugcuguga

SEQ ID NO: 1706 - RNA, 1710 nt, Artificial Sequence
  derived and/or modified CDS sequence (opt3) from Lassa virus__AFY05616__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccugaauaugaucgggauguccggaggcaaccagggugcccgcgcugggcgagacggaguggucagagugugggauguaaagaaugcagagcuucugucaaaccaguucggcacaaugccuaguuugacucucgccugucugaccaaacagggccaaguugacuuaaaugaugcugugcaggcccugacagaccucgggcuuauuuacaccgcgaaguauccaaacacuagcgaccuggauagguuggcacagucucauccgauccuaaauaugauagacacaaagaaauccucacugaacaucagcggauacaauuuuagucucggugccgcugucaaggccggcgcaugcaugcuggaugggggaaacaugcuugaaaccauuaaagugucuccccaaacgauggacggcauccugaaguccauuuugaaagugaagaaagcucucgguauguucaucagcgauacuccuggggagcggaacccauaugaaaauauacuguacaagauuuguuuaucgggagacggcuggcccuauaucgccucucguaccuccauuacaggccgcgcgugggagaacacugucguugaucuggagucagacgggaagccucagaaagccgauaguaauaacagcuccaagucucuacagagcgcaggauuuaccgcuggucucacauacucacagcugaugacccuuaaagacgccauguugcaacuggauccaaaugcuaagacguggauggacaucgaaggcagacccgaggacccuguggaaaucgcccucuaccagccaaguuccgggugcuauauucacuucuuuagggagccgacugaucugaaacaguucaagcaggacgcaaaguacagccauggaauagauguaacagaccuuuuugccacccaacccggccugacuucugcugugaucgaugcguugccucggaacauggucauuacaugucaggguucagacgauauccgaaaacuccuggaaagucaggggcgcaaggacauaaaauuaauugauaucgaccugagcaagaccgauuccagaaaauaugagaaugcagugugggaccaguacaaggaucuaugccacaugcauacgggcguuguggucgagaagaaaaagaggggaggcaaagaagagaucaccccacacugugcccucauggacugcauuauguucgacgcugccgugucugggggacugaacacaucgguacuucgggcaguuuugccccgcgauaugguguuuagaacuagcaccccuagggucgugcuguga

SEQ ID NO: 1707 - RNA, 1716 nt, Artificial Sequence
  derived and/or modified CDS sequence (opt3) from Lassa virus__AFY05618__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuucgcaguaaggugauuagaaccgagaggcccuuguccgccgguguuuauaugggcaaccugucuagccagcagcuagaucaacggcgcgcacuccugaauaugaucgggauguccggaggcaaccagggugcccgagcugggagagacggaguggucagggugugggauguuaaaaaugcagagcuucugucaaaccaguucggcacaaugccuaguuugacucucgccugucugaccaagcagggccaaguagacuuaaaugaugcugugcaggcccugacagaccucgggcuuauuuacaccgcgaaauauccaaacacuagcgaccuggaucgguugacacagucucauccgauccuaaauaugauagacaccaagaaguccucacugaacaucagcggauacaauuuuagucucggugcagccgucaaagcuggcgccugcaugcuggaugggggaaacaugcuugaaacgauuaaggugucuccccaaacuauggacggcauccugaaauccauuuugaaggugaaaaaggcacucgguauguucaucagcgauaccccuggggagcguaacccauaugaaaauauacuguacaaaauuuguuuaucgggagacggcuggcccuauaucgcuucucgcacauccauuacuggcagagccugggagaacaccgucguugaucuggagucagacgggaagccucagaaggcggauaguaauaacagcuccaaaucucuacagagcgccggauuuacagcaggucucaccuacucacagcugaugacgcuuaaggacgcuauguugcaacuggauccaaaugccaaaacuuggauggacaucgaaggcaggcccgaggacccuguggaaaucgcucucuaccagccaaguuccgggugcuauauucacuucuuucgggagccgacagaucugaagcagaaacaguucaagcaagacgccaaguacagccauggaauagauguaaccgaccuuuuugcaacucagcccggccugacaucugccgugaucgaugcuuugccucgaaacauggucauuaccugucaggguucagacgauauccgcaaacuccuggaaagucaggggagaaaggacauaaaauuaauugauaucgaccugagcaagacggauuccaggaaauaugagaaugcggugugggaccaauacaaggaucuaugccacaugcauaccggcguuguggucgagaagaaaaagcggggaggcaaagaagagaucacaccacacugugcacucauggacugcauuauguucgacgccgcugugucugggggacugaacacuucgguacuucgcgccguuuugcccagagauaugguguuuaggaccagcacaccucgugucgugcuguga

SEQ ID NO: 1708 - RNA, 1710 nt, Artificial Sequence
  derived and/or modified CDS sequence (opt3) from Lassa virus__AHC95552__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagcgacgugacgauggagaccucaaaagacugagggaucuuaaccaagccgugaauaaccuggucgaauugaagucgacacagcagaagaaugugcuccggguugguacucugaacucagacgaucugcucacguuagcggcugaccuggagaaacuuaagagcaaagugacccgcacagaaagacccuugaguuccggcgucuauauggggaaucugucuagccagcaacuagaucagaggcgggcccuccugaacaugauuggaaugacuggcgguaaucaggggacccaggcaggacgcgacggcgugguacgaguuugggaugugaagaacgccgagcuucugaauaaccaauucggcacaaugccuuccuugacccucgcuugucugacuaaacaggggcaggcagacuuaaaugaugucgugcaagcccugacagaccucggacuuauauacaccgcuaaguauccaaacgccucagaccuggauagauugacgcagagucauccgauccuaaauaugauugacacuaagaaaagcucucugaacaucuccgguuacaacuuuucacucggcgcggcagugaaggccggggcuugcaugcuggauggaggcaauaugcuugagaccauuaaagucagcccccagaguauggacgguauccugaagucuauauugaaaguuaagagggcccucgggauguucguguccgauacaccuggagaacggaacccauaugagaauauccuguacaaaauuuguuuaagcggcgacggcuggcccuauaucgcaucgcguacuucuauuguagggcgcgcuugggaaaacaccguggucgaucuggaggccgacggaaauccuaagaagcuaaacuccaaugguucaaacaaaagucuccagagcgcgggcuuuccagccgggcugacauacucccaacuuaugaccuugaaggaugcaaugcugcagcucgaccccaaugcuaaaacguggauggauaucgagggaagaccugaagacccaguggagguugcccuguaccagccgaacucuggcugcuauauacacuucuuuagggaacccacugaccuuaagcaguucaaacaagaugcuaaguacagccaugguauugacgugacagaucuguuugccgcacagccuggguugaccucagccgucaucgaggcucucccacggaauauggugauuacuugucagggcagugaagacauccgaaagcuguuagagucccagggacgcaaagauaucaagcugauugacauagcgcuaagcaaaacagauucuagaaaguucgagaacgcaguaugggaccaauauaaagaucucugccacaugcauaccggcguuguggucgaaaagaagaaaaggggagggaaggaggaaaucacgccccacugugcccugauggacugcauuauguuugaugcugccgugucagguggccuuaauaccuugguccugcgggcagugcucccucgcgacaugguuuucagaacaaguacuccaagggugguacuguga

SEQ ID NO: 1709 - RNA, 1710 nt, Artificial Sequence
  derived and/or modified CDS sequence (opt3) from Lassa virus__AHC95554__NP
augagcgccuccaaggaggugagaucuuuccuguggacccagucacucaggcgggaacuuaguggcuacugcagcaacaucaaacugcaagucguuaaggacgcucaggcauuguuacacgggcuggauuuuuccgaggugucuaauguacagcgccuaaugcgaaaacagcguagagacgauggagaccucaagaggcugcgggaucuuaaccaagccgugaauaaccuggucgaauugaaaucgacacagcagaagucagugcuccgcguugguacucugaauagcgacgaucugcucacguuagcggcugaccuggagaaacuuaagaguaaggugaccagaacagaaaggcccuuguccucuggcgucuauauggggaaccugagcucccagcaacuagaucagcggcgcgcccuccugaauaugauuggaaugacuggcgguaaccagggggcacaggccggacgagacggcgugguaagaguuugggaugugaaaaaugcugagcuucugaacaaucaauucggcaccaugccuucauugacacucgcaugucugaccaagcaggggcaggucgacuuaaacgauguggugcaagcccugacugaccucggacuuauauacacagcuaaauauccaaauaccagugaccuggauagguugacgcagagccauccgauccuaaacaugauugacacuaagaagucuucccugaauaucucagguuacaacuuuagccucggcgccgcggucaaagcaggggccugcaugcuggauggaggcaacaugcuugagaccauuaagaucaguccccagucuguugacgguauacugaaauccaucuugaaggugaaacggagccucgggauguucguaucggauacaccuggagaacguaauccauaugagaacauucuguacaagaucuguuuaucuggcgacggcuggcccuauauugcuucccgcacuucaaucguggggagagccugggaaaauaccgucguggaucuggaggcagacggaaaaccucagaagccaaacagugguagcuccaauaagucucuacaaagcgcuggcuuucccgccgggcucacauacucacagcugaugacccuuaaagaugcgauguugcagcuggacccuaacgccaagacguggauggauauagagggaaggccagaagacccgguugagguggcacucuaccagcccaguuccggcugcuauauucacuucuuucgggaaccuacugaccugaaacaauucaagcaggaugcuaaauacagccaugguaucgacgucacagaucuuuuugccgcucagccagggcugaccucugccgugauugaggcauugccccgaaauaugguaaucacuugucagggcucagaagacaucaagaagcuccuggagagucaaggacgcaaagauauuaaguuaauagacaucgcccugagcaaaauugauuccagaaaguucgagaacgcuguuugggaccaguauaaagaucuaugccacaugcauacaggcguggucguggaaaagaagaaaaggggagggaaggaggaaaucaccccucacugugcgcucauggacugcauaauguuugaugcagccgucucugguggccugaaugcuucggugcuucgggccguuuugccacgcgacaugguguucagaacgagcacccccaaaguaguccuguga

SEQ ID NO: 1710 - RNA, 1710 nt, Artificial Sequence
  derived and/or modified CDS sequence (opt3) from Lassa virus__AHC95556__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagcgacgugacgauggagaccucaaaagacugagggaucuuaaccaagccgugaauaaccuggucgaauugaagucgacacagcagaagaaugugcuccggguugguacucugaacucagacgaucugcucacguuagcggcugaccuggagaaacuuaagagcaaagugacccgcacagaaagacccuugaguuccggcgucuauauggggaaucugucuagccagcaacuagaucagaggcgggcccuccugaacaugauuggaaugacuggcgguaaucaggggacccagacaggacgcgacggcgugguacgaguuugggaugugaagaacgcagagcuucugaauaaccaauucggcaccaugccuuccuugacucucgccugucugacaaaacaggggcaggcugacuuaaaugaugucgugcaagcacugaccgaccucggacuuauauacacggccaaguauccaaacgcuucagaccuggauagauugacucagagucauccgauccuaaauaugauugacaccaagaaaagcucucugaacaucuccgguuacaacuuuucacucggcgccgcggugaaggcaggggccugcaugcuggauggaggcaauaugcuugagacaauuaaagucagcccccagaguauggacgguauccugaagucuauauugaaaguuaagagggcucucgggauguucguguccgauacuccuggagaacggaacccauaugagaauauccuguacaaaauuuguuuaagcggcgacggcuggcccuauaucgccucgcguaccucuauuguagggcgcgcaugggaaaacacaguggucgaucuggaggcugacggaaauccuaagaagcuaaacuccaaugguucaaacaaaagucuccagagcgccggcuuuccagcggggcugaccuacucccaacuuaugacguugaaggaugccaugcugcagcucgaccccaaugcaaaaacuuggauggauaucgagggaagaccugaagacccaguggagguugcucuguaccagccgaacucuggcugcuauauacacuucuuuagggaacccacagaccuuaagcaguucaaacaagaugccaaguacagccaugguauugacgugaccgaucuguuugcugcccagccuggguugacuucagcagucaucgaggcccucccacggaauauggugauuacaugucagggcagugaagacauccgaaagcuguuagagucccagggacgcaaagauaucaagcugauugacauagcucuaagcaaaaccgauucuagaaaguucgagaacgcgguaugggaccaacacaaagaucucugccauaugcacacgggcguuguggucgaaaagaagaaaaggggagggaaggaggaaaucacuccccacugugcacugauggacugcauuauguuugaugccgcugugucagguggccuuaauacauugguccugcgggccgugcucccucgcgacaugguuuucagaaccaguaccccaaaagugguacuguga

SEQ ID NO: 1711 - RNA, 1710 nt, Artificial Sequence
  derived and/or modified CDS sequence (opt3) from Lassa virus__AHC95558__NP
augagcgccuccaaggaggugagaucuuuccuguggacccagucacucaggcgggaacuuaguggcuacugcagcaacaucaaacugcaagucguuaaggacgcucaggcauuguuacacgggcuggauuuuuccgaggugucuaauguacagcgccuaaugcgaaaacagcguagagacgauucggaccucaagaggcugcgggaucuuaaccaagccgugaauaaccuggucgaauugaaaucaacacagcaaaagagcgugcuccgcguuggaacucugaguuccgacgaucugcucacguuagcggcugaccuggagaagcugaaaucuaaggugauuagaaccgaaaggcccuugagcuccggugucuauaugggcaaucugucaagucagcagcuagaucagcggcgcgcccuccugaacaugauagggaugacaggaggcaaucagggugcacaggccgggcgagacggagugguaagaguuugggaugugaggaacgcugagcuucugaauaaccaauucggcacuaugccuagcuugacccucgcaugucugacaaaacagggccaggucgacuuaaaugauguggugcaagcccugaccgaccucgggcuuaucuacacugcuaaguauccaaacacaucugaccuggaucgguugacccagaaucauccgauucuaaacaugaucgacacgaaaaaguccucacugaauauuagcggauacaacuuuagucucggugccgcggucaaggcaggcgccugcaugcuggaugggggaaacaugcuugagacuaucaaaguuucuccccaguccauagacggcauccuuaagagcauuuugaaagugaagcguacccucgguauguucguaucggauacaccuggggaacgcaauccauaugagaacauccuguacaaaauuuguuuaucuggagacggcuggcccuauaucgcuuccagaacuucaauagugggcagggccugggaaaauaccgucguggaucuggagacagaccggaagagucaggggccuaacagcggaaauuccaacaaaucucuacaaagcgcagguuuuucagcuggccucaccuacagucagcugaugacgcuuaaggaugccauguugcagcuggacccaaaugcgaagacuuggauggauauugaggggcgacccgaagacccuguugagguggcccucuaccagccaaucuccggaugcuauauucacuucuuucgcgaaccgacagaccugaaacaauucaagcaggaugcaaaauacagccauggcaucgacaucaccgaucuuuuugcugcccagcccggucugacuucugcugucauugaggccuugccuagaaacauggugauaacaugucaggggucagaagacaucaagaaacuccuggagagucaaggcaggaaggauauuaaguuaaucgacauagcacugagcaaaauugauucccggaaguucgagaaugccguaugggaccaguauaaagaucuaugccacaugcauaccggaguuguggucgaaaagaaaaagcgcggcgggaaggaggaaaucacgccacacugugcucucauggacugcaucauguuugaugcggcagugucuggaggucugaacgccucgguccuuagagcuguguugcccagggacaugguuuuccguaccagcacaccuaaagugguacuguga

SEQ ID NO: 1712 - RNA, 1710 nt, Artificial Sequence
  derived and/or modified CDS sequence (opt3) from Lassa virus__AHC95560__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagcgacgugacgauggagaccucaaaagacugagggaucuuaaccaagccgugaauaaccuggucgaauugaagucgacacagcagaagaaugugcuccggguugguacucugaacucagacgaucugcucacguuagcggcugaccuggagaaacuuaagagcaaagugacccgcacagaaagacccuugaguuccggcgucuauauggggaaucugucuagccagcaacuagaucagaggcgggcccuccugaacaugauuggaauguccggcgguaaucaggggacucaggugggacgcgacggcguaguucgagugugggaugucaagaacgcagagcuucugaauaaccaauucggcaccaugccuucauugacacucgccugucugaccaaacaggggcaggcugacuuaaaugauguggugcaagcacugacugaccucggacuuauauacacagccaaguauccaaacgcuagugaccuggauagauugacccagagccauccgauccuaaauaugauugacacgaagaaaucuucccugaacaucucagguuacaacuuuagccucggcgccgcggucaaggcaggggccugcaugcuggauggaggcaauaugcuugagacuauuaaaguuaguccccagucuauggacgguauccugaaguccauauugaaagugaagagggcucucgggauguucguaagcgauaccccuggagaacggaacccauaugagaauauccuguacaaaauuuguuuaucgggcgacggcuggcccuauaucgccucucguacauccauuguggggcgcgcaugggaaaacacugucguggaucuggaggcugacggaaauccuaagaagcuaaacucaaaugguaguaacaaaagccuccaguccgccggcuuuccagcggggcugaccuacucucaacuuaugacauugaaggaugccaugcugcagcucgaccccaaugcaaaaaccuggauggauaucgagggaagaccugaagacccaguugagguggcucuguaccagccgaacagcggcugcuauauacacuucuuuagggaacccacggaccuuaagcaguucaaacaagaugccaaguacucacaugguauugacgucacugaucuguuugcugcccagccuggguugacaagugcagugaucgaggcccucccacggaauaugguaauuaccugucagggcuccgaagacauccgaaagcuguuagagagccagggacgcaaagauaucaagcugauugacauagcucuaucuaaaacugauucaagaaaguucgagaacgcgguuugggaccaacacaaagaucucugccauaugcacacaggcguggucguggaaaagaagaaaaggggagggaaggaggaaaucacgccccacugugcacugauggacugcauuauguuugaugccgcugucagugguggccuuaauaccuuggugcugcgggccguucucccucgcgacaugguguucagaaccagcacaccaaaaguaguccuguga

SEQ ID NO: 1713 - RNA, 1710 nt, Artificial Sequence
  derived and/or modified CDS sequence (opt3) from Lassa virus__AIT17127__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccuguccaugaucgggaugucaggaggcaaucagggugugcgcgccgggaaggacggagucgugcgaguaugggauguuaaaaacgcugagcuucugaauaaccaguucggcacaaugccuaguuugacucucgcaugucugaccaagcagggccaaguggacuuaaaugaugccguccaggcucugacagaccucgggcuuauuuacaccgccaaguauccaaacacuagcgaccuggauagauugacacagucucauccgauccuaaauaugauagacaccaaaaaguccucacugaacaucagcggauacaauuuuagucucggugcggcagugaaagccggcgcuugcaugcuggaugggggaaacaugcuugaaacgauuaaggugucuccccaaacuauggacggcauccugaaauccauuuugaaggucaaaaaggcccucgguauguucaucagcgauaccccuggggagaggaacccauaugaaaauauacuguacaagauuuguuuaucgggagacggcuggcccuauaucgcaucucggacauccauuacuggccgugcuugggagaacaccguuguggaucuggagucagacgggaaaccucagaaggccggaaguaauaacagcaauaaaucccuacagucugcggguuuuacagccggccucaccuacagccagcugaugacgcuuaaggaugcaauguugcaacuggacccaaacacuaaaacauggauggauaucgaagggcgccccgaggacccuguagaaaucgcucucuaccagccaucaaguggaugcuauauucacuucuuuagagagccgaccgaccugaagcaguucaagcaggaugccaaauacucccauggcauagacgugacugaucuuuuugcugcccaacccggucugacaagcgcagucaucgacgccuugccuaggaauauggugauuaccugucaggggucugaugacauccggaagcuccuggaaucacagggccgaaaagauauaaaguuaauugacaucgcucugaacaaaacggauagucgcaaguaugagaaugcgguuugggaccaguacaaggaucuaugccacaugcauaccggaguggucguggagaaaaagaaaagaggcgggaaggaagagaucacaccacacugugcacucauggacugcauuauguucgaugccgcuguaagcggaggucugaacacuuccguucuuagggccguguugccccgggacauggucuuucgcaccucuacaccuagagugguccuguga

SEQ ID NO: 1714 - RNA, 1710 nt, Artificial Sequence
  derived and/or modified CDS sequence (opt3) from Lassa virus__AIT17131__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugagcagugacgaucugcucguguuagcggcugaccuggaaaaacuuaaguccaaaguuacgcgcaccgagagacccuugucugccgguguguauaugggcaaccugagcucccagcagcuagaucaaaggcgggcacuccugaauaugaucgggaugucaggaggcaaccagggugcccgcgcugggcgagacggagucgugagaguaugggauguuaagaaugcagagcuucugaacaaucaguucggcacaaugccuaguuugacucucgccugucugaccaaacagggccaaguggacuuaaacgaugucgugcaggcucugacagaccucgggcuuauuuacaccgccaaguauccaaauacuagcgaccuggauagguugacacagucucauccgauccuaaacaugguggacaccaagaaauccucacugaauauuagcggauacaacuuuagucucggugcggcagucaaggccggcgcuugcaugcuggaugggggaaacaugcuugaaacgaucaaaguuucuccccaaacuauagacggcauccugaaguccauuuugaaagugaagaaagcccucgguauguucaucagcgauaccccuggggagcggaauccauaugaaaacauucuguacaagaucuguuuaucgggagacggcuggcccuauauagcaucucguacauccauuacuggccgcgcuugggagaauaccguaguggaucuggagucagacgggaagccucagaaagccggaaguaacaauagcaacaagucccuacagucugcggguuuuacagccggccucaccuacagccagcugaugacgcuuaaagaugcaauguugcaacuggacccaaaugcuaagaucuggauggauauugaagggagacccgaggacccugucgaaaucgcccucuaccagccaucaaguggaugcuauauccacuucuuuagggagccgacugaccugaaacaguucaagcaggaugcuaaguacucccauggcauugacgugacagaucuuuuugccgcacaacccggucugaccagcgccguuauagacgcuuugccucggaacauggugaucacuugucagggggcggaugacauucgaaaacuccuggaaucucagggccgcaaggauaucaaauuaauagacauugcacugaauaaggccgauucaagaaaauaugagaacgcugucugggaccaguacaaggaucuaugccacaugcauacaggagugguaguugagaagaaaaagaggggcgggaaagaagagaucaccccacacugugcccucauggacugcaucauguucgaugcagccgugaguggaggucugaauacgagcguccuucgggcuguguugccccgcgacauggucuuuagaaccuccacaccuagggugguucuguga

SEQ ID NO: 1715 - RNA, 1710 nt, Artificial Sequence
  derived and/or modified CDS sequence (opt3) from Lassa virus__AIT17139__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuacccgcacagagagacccuuguccgccgguguguauaugggcaaccugucuagccagcagcuagaucaaaggcgggcacuccugaauaugaucgggauguccggaggcaaccagggugcccgcgcugggcgagacggagucgugagaguaugggauguuaagaaugcagagcuucugaacaaucaguucggcacuaugccuucauugacccucgccugucugacaaaacagggccaaguggacuuaaacgaugcuguccaggcccugaccgaccucgggcuuauuuacacugcgaaguauccaaauacaagugaccuggauagguugacccagagccauccgauccuaaacaugauugacacgaagaaaucuucccugaauaucucaggauacaacuuuagccucggugcagccgugaaggcuggcgccugcaugcuggaugggggaaacaugcuugaaacuauaaaagugaguccccaaaccauggacucuauccugaaguccauuuugaaagucaagaaagcacucggcauguucaucagcgauacaccuggugagcggaauccauaugaaaacauucuguacaagaucuguuuaucgggggacggauggcccuauauagcuucucguacuuccauuaccggccgcgccugggagaauacaguuguggaucuggagucagacggcaagccucagaaagcggggaguaacaauagcaacaagucccuacagucugccggauuugcagcuggucucaccuacagccagcugaugacgcuuaaagaugccauguugcaacuggacccaaaugcuaagacuuggauggauaucgaaggcagacccgaggacccuguagaaauugcccucuaccagccaucaagugggugcuauauccacuucuuuagggagccgacagaccugaaacaguucaagcaggaugcaaaguacucccauggaaucgacgugaccgaucuuuuugccgcucaacccggccugacuagcgcggucauugacgcauugccucggaacauggugauaacaugucaggguucugaugacauccgaaaacuccuggaaucacaggggcgcaaggauauuaaauuaaucgacauagcccugaguaagaccgauagcagaaaauaugagaaugcuguuugggaccaguacaaggaucuaugccacaugcauacgggcauuguggucgagaagaaaaagaggggaggcaaagaagagaucaccccacacugugcccucauggacugcaucauguucgaugcagccguguccgggggacugaacacaucuguacuucgggcuguuuugccccgcgacaugguguuuagaacuaccacaccuagggucgugcuguga

SEQ ID NO: 1716 - RNA, 1710 nt, Artificial Sequence
  derived and/or modified CDS sequence (opt3) from Lassa virus__AIT17143__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccgcgcuggucgagacgggguggucagagugugggauguaaagaaugcagagcuucugaacaaucaguucggaacuaugccuaguuugacccucgccugucugacaaaacagggccaaguugacuuaaacgaugcugugcaggcccugaccgaccucggccuuaucuacacugcgaaguauccaaauacaagcgaccuggauagguugacccagucucauccgauucuaaacaugaucgacacgaagaaauccucacugaauauaagcggguacaacuuuagucucggagcagccgucaaggcuggugccugcaugcuggauggcgggaacaugcuugaaacuaucaaagugucuccccaaaccauggacggcauucugaaguccaucuugaaagugaagaaagcacucggaauguucauuagcgauacaccuggugagcggaauccauaugaaaacauccuguacaagauauguuuaucgggggacggauggcccuauauugcuucucguacuuccaucaccggccgcgccugggagaauacagucguugaucuggagucagacggcaagccucagaaagcggggaacaauggaaguaacaagagccuacaguccgccgguuuuaccgcaggccucacguacucucagcugaugacucuuaaagaugcuauguugcaacuggacccaaaugccaagacauggauggauauugaagggagacccgaggacccuguggaaaucgcucucuaccagccaagcucaggaugcuauauccacuucuuuagggagccgaccgaccugaaacaguucaagcaggaugccaaguacagucauggcauugacguaacugaucuuuuugcagcccaacccggucugacauccgcugugauagacgcguugccucggaaccucgucaucaccugucaggggagcgaugacauucgaaaacuguuagaaucucagggccgcaaggauaucaaacugauagacauugcacuaucaaagacggauaguagaaaauaugagaaugccgugugggaccaguacaaggaucucugccacaugcauaccggaaucguuguggagaagaaaaagaggggcgggaaagaagagaucacaccacacugugcucugauggacugcauuauguucgaugccgcagucagcggaggucuuaacacuuccguguugcgggccguacugccccgcgacaugguuuuuagaaccucuacaccuagggugguccucuga

SEQ ID NO: 1717 - RNA, 1710 nt, Artificial Sequence
  derived and/or modified CDS sequence (opt3) from Lassa virus__AIT17147__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuacccgcacagagagacccuuguccgccgguguguauaugggcaaccugucuagccagcagcuagagcaaaggcgggcacuccugaauaugaucgggauguccggaucaaaccagggcgcccaggcuggucgcgauggggucgugcgaguaugggacguuaagaaugcagaacuucugaacaaucaguucggaacuaugccuaguuugacccucgccugucugacaaaacaaggccagguggauuuaaacgacgcuguccaggcccugaccgaucucggccuuauuuacacugugaaguauccaaauacaagcgaccuggacagauugacccaaucucauccgauccuaaacaugauugauacgaagaaauccucacugaauaucagcggguacaacuuuagucucggagcggcagugaaggccggugcuugcaugcuggacggcgggaacaugcuugagacuauaaaagucucuccccagaccauggauggaauccugaaguccauuuugaaaguuaagaaagcccucggcauguucaucagcgacacaccuggugaaaggaauccauaugagaacauucuguacaagaucuguuuaucgggggauggauggcccuauauagcaucucggacuuccauuaccggccgugcuugggagaauacagugguagaccuggaaucagauggcaagccucagaaagccgacaguaacagcuccaauaagucucuacagagcgcgggguuuaccgccggacucacguacucacaacugaugacucuuaaagaugcaauguugcagcuggacccaaacgcuaagacauggauggauaucgagggucgccccgaagacccuguggaggucgcccucuaccagccaaguuccggcugcuauauucacuucuuuagagaaccgaccgaccugaaacaguucaagcaagaugcuaaguacagccaugggaucgacgugacugaucuuuuugccgcacagcccggacugacaucugccguuaucgacgcuuugccuaggaauauggugauuaccugucagggcucagaugacauacggaaacuccuggagagucagggucgaaaggauaucaaauuaauugacaucgcgcugagcaagacggauucccgcaaauaugagaacgcagucugggaccaauacaaggaucuaugccacaugcauaccggggugguaguugaaaagaaaaagagaggcggaaaagaggaaauaacaccacacugugcccucauggacugcauuauguucgaugcugccgugucuggcgggcugaauacuucgguccuuagggcaguguugccccgggacauggucuuucgcaccagcacaccuagagugguucuguga

SEQ ID NO: 1718 - RNA, 1710 nt, Artificial Sequence
  derived and/or modified CDS sequence (opt3) from Lassa virus__AIT17151__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccuguccaugauugggaugucaggaggcaaucagggugcccgcgcugggcgagacggaguggucagagugugggauguaaagaacgcagagcuucugaauaaccaguucggcacuaugccuaguuugacccucgccugucugacaaaacagggccaaguugacuuaaaugaugugguccaggcucugaccgaccucgggcuuaucuacacugccaaguauccaaacacaagcgaccuggauagguugacccagucucauccgauucuaaauaugaucgacacgaagaaauccucacugaacauaagcggauacaauuuuagucucggugcggcagugaaggccggcgcuugcaugcuggaugggggaaacaugcuugaaacuaucaaagugucuccccaaaccauggacggcauucugaaguccaucuugaaagucaagaaagcccucgguauguucauuagcgauacaccuggggagcggaacccauaugaaaauauccuguacaagauauguuuaucgggagacggcuggcccuauauugcaucucguacuuccaucaccggccgcgcuugggagaacacaguuguggaucuggagucagacgggaagcuacagaaagccggaaguaauaacagcaauaagucccuccagucugcggguuuuaccgccggccugacguacagccagcuuaugacuuugaaagaugcaaugcugcaacucgacccuaacgcuaagacauggauggauauugaagggagaccagaggaccccguagaaaucgcccuguaccagccuucaaguggaugcuauauccacuucuuuagggagccaaccgaccuuaaacaguucaagcaggaugcuaaguacucccauggcauugacgugacugaucuguuugccgcacaaccggguuugacaagcgccgucauagacgcucucccccggaauauggugaucaccugucaggggucugaugacauucgaaaacuguuagaaucacagggccgcaaggauaucaaacugauagacauugcgcuaaacaagacggauaguagaaaauaugagaaugcaguuugggaccaguacaaggaucucugccacaugcauaccggaguggucguggagaagaaaaagaaaggcgggaaggaagagaucacaccucacugugcccugauggacugcaucauguucgaugcugccguaagcggaggucuuaacacuuccguuuugagggcagugcugccacgggacauggucuuucgcaccucuacacccagagugguccucuga

SEQ ID NO: 1719 - RNA, 1710 nt, Artificial Sequence
  derived and/or modified CDS sequence (opt3) from Lassa virus__AIT17155__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaacugcucguuuuagcggcugaucuggagaaacuuaagaguaaagugauacgcaccgagagacccuuguccgccggugucuauaugggcaaccugucuagccagcagcuagaccaaaggcgggcacuccuguccaugaucgggaugucaggaggcaaucagggugcccgcacagggcgagauggagugguaagaguuugggacgugaagaacgcugaacuucugaauaaccaguucggcacuaugccuaguuugacccucgcaugucugacaaaacagggccaagucgauuuaaaugacgccgugcaggcucugaccgaucucgggcuuauuuacacugccaaguauccaaacacaagcgaccuggacagguugacccagucucauccgauccuaaauaugauugauacgaagaaauccucacugaacaucagcggauacaauuuuagucucggugcggcagugaaggccggcgcuugcaugcuggacgggggaaacaugcuugagacuauaaaagucucuccccaaaccauggauggcauccugaaguccauuuugaaaguuaagaaagcccucgguauguucaucagcgacacaccuggggaacggaacccauaugagaauauucuguacaagaucuguuuaucgggagauggcuggcccuauauagcaucucguacuuccauuaccggccgcgcuugggagaacacagugguagaccuggaaucagaugggaagccucagaaagccggaaguaauaacagcaauaagucccuacagucugcggguuuuaccgccggccucacguacagccagcugaugacucuuaaagacgcaauguugcaacuggauccaaacgcuaagacauggauggacaucgaggggagacccgaagauccuguggagauugcccucuaccagccaucaaguggaugcuauauccacuucuuuagggaaccgaccgaccugaaacaguucaagcaggacgcuaaguacucccauggcaucgaugucacugaccuuuuugccgcacaacccggucugacaagcgccgugauugaugcuuugccucggaauaugguuauaaccugucaggggucugacgauauccgaaaacuccuggagucacagggccgcaaggacauuaaauuaaucgauauagcgcugaguaagauugacagcagaaaauaugagaacgcagugugggaucaguacaaggaccuaugccacaugcauacgggagucgugguagaaaagaaaaagaggggcgggaaagaggaaaucaccccacacugugcccucauggauugcaucauguucgacgcugccguuuccggaggucuuaauucucugguguugcgggcaguccugccccgcgauaugguguuuagaacaucgacuccuagggucgugcucuga

SEQ ID NO: 1720 - RNA, 1710 nt, Artificial Sequence
  derived and/or modified CDS sequence (opt3) from Lassa virus__AIT17161__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccgcacuggucgagacgggguggucagagugugggauguaaagaaugcugagcuucugaacaaucaguucggaaccaugccuaguuugacacucgcaugucugaccaaacagggccaaguugacuuaaacgaugccgugcaggcucugacugaccucggccuuaucuacacagccaaguauccaaauaccagcgaccuggauagguugacgcagucucauccgauucuaaacaugaucgacacuaagaaauccucacugaauauaagcggguacaacuuuagucucggagcggcagucaaggccggugcuugcaugcuggauggcgggaacaugcuugaaaccaucaaagugucuccccaaacaauggacggcauucugaaguccaucuugaaagugaagaaagcccucggaauguucauuagcgauacuccuggugagcggaauccauaugaaaacauccuguacaagauauguuuaucgggggacggauggcccuauauugcaucucguaccuccaucacaggccgcgcuugggagaauaccgucguugaucuggagucagacggcaagccucagaaagccgggaguaacagcuccaauaagucucuacagagcgcgggacucacggccggucugacuuacucacagcuuaugacauugaaagaugcaaugcugcaacucgacccaaacgcuaagaccuggauggauauugaaggcagacccgaggacccuguggaaaucgcccuguaccagccaaguuccgggugcuauauccacuuuuucagggagccgacugaccuuaaacaguuuaagcaggaugcuaaguacagccauggaauugacguaacagaucuguucgccgcacaacccggcuugaccucugccgugauagacgcucucccucggaaucuggucaucacgugucaggguucagaugacauucgaaaauuacuggaaagucaggggcgcaaggauaucaaacuaauagacauugcgcucagcaagaccgauuccagaaaauaugagaacgcagugugggaccaguacaaggaucugugccacaugcauacaggcaucguuguggagaagaaaaagaggggaggcaaagaagagaucacuccacacugugcccuuauggacugcauuauguuugaugcugccgucucugggggauugaaugcaucggugcugcgggccguacucccccgcgacaugguuuucagaaccagcacaccuagggugguccuguga

SEQ ID NO: 1721 - RNA, 1710 nt, Artificial Sequence
  derived and/or modified CDS sequence (opt3) from Lassa virus__AIT17165__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuaauaacgugcagcggcuaaugcgcaaggaacgacgugacgauaaugaccucaaaagacugagggaucuuaaccaggccguaaauaaccugguggaguugaagucuacacaacagaagucgauacuccgggucggaacucugacgucagacgaucugcucaucuuagcggcugaccuggaaaaacuuaagagcaaagugacccgcacagagagacccuugagugccgguguuuauaugggcaaucuguccucucagcagcuagaucaaaggcgggcacuccugaacaugauugggaugagcaauggaaaccagggcacucgcgccggucgagacgggguggucagagugugggauguaaagaaugcugagcuucugaacaaucaguucggaaccaugccuuccuugacacucgcaugucugaccaaacagggccaaguugacuuaaacgaugugguccaggcccugacugaccucggccuuaucuacacagcuaaguauccaaauaccucagaccuggauagguugacgcagagucauccgauucuaaacaugaucgacacuaagaaaagcucucugaacauauccggguacaauuuuucacucggagccgcggugaaggcaggagccugcaugcuggauggcgggaacaugcuugaaaccaucaaagugagcccccaaacaauggacgguauucugaagaguaucuugaaagucaagaaagcucucggcauguucauuucugauacuccuggugagcggaauccauaugaaaacauccuguacaagauauguuuauccggggacggauggcccuauauugccagccguaccucgaucacaggccgcgcaugggagaauaccguuguggaucuggagucugacggcaagccucagaaagcugauuccucaaacaguaauaagagccuacaguccgccggguuuacggcgggacucacuuacucucagcugaugacacuuaaagacgccauguugcaacuggauccaaacgcaaagaccuggauggacauugaagguagacccgaggacccuguagaaguggcucucuaccagccaagcucaggcugcuauauccacuucuuuagggagccgacugaucugaaacaguucaagcaggacgccaaguacagucaugggaucgaugucacagaccuuuuugcugcccaacccggacugaccuccgcagugauugaugccuugccucggaauaugguuauaacgugucagggcagcgacgauauccgaaaacuccuggaaucucagggucgcaaggacauuaaauuaaucgauauagcucugucaaaggcggacaguagaaaauaugagaacgcagugugggaucagcacaaggaccuaugccauaugcacaccggggucgugguagagaagaaaaagaggggcggaaaagaagagauuacaccacacugugcccucauggauugcaucauguacgacgcugccguuagcggcgggcugaauacuuccgugcuucgggcagucuugccccgcgacaugguguucagaaccucuacaccuagggucgugcuguga

SEQ ID NO: 1722 - RNA, 1710 nt, Artificial Sequence
  derived and/or modified CDS sequence (opt3) from Lassa virus__AIT17169__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccuguccaugaucgggaugucaaguggaaaucagcgcgcccaggcuggccgagacgguguggucagagugugggauguaaagaacguugagcuucugaauaaccaguucgggacaaugccuagcuugacucucgcaugucugaccaaacaaggacagguggacuuaaaugaugccguccaggcucugacagaccucggccuuauuuacaccgccaaguauccaaacacuucugaccuggauagguugacacaaucccauccgauccuaaauaugauagacaccaagaaaucaagccugaacaucaguggcuacaauuuuucucucggggcggcagugaaggccggagcuugcaugcuggaugguggcaacaugcuugaaacgauuaaagugagcccccagacuauggacgggauccugaaguccauuuugaaagucaagaaagcccucggaauguucaucucggauaccccuggcgagcggaacccauaugaaaauauacuguacaagauuuguuuaucuggugacggguggcccuauaucgcaucccguacaucaauuacuggacgcgcuugggagaacaccguuguggaucuggagagugacggcaagccucagaaagccggcagcaauaacuccaauaagucucuacagagcguaggguuuacagcgggacucaccuacucacaacugaugacgcuuaaagaugccauguugcagcuggacccaaacgcaaagacuuggauggauaucgaagguagacccgaggacccuguggaaaucgcucucuaccagccaaguuccggcugcuauauucacuucuuuagggagccgacagaccugaaacaguucaagcaagaugccaaguacagccaugggauagacgucaccgaucuuuuugcugcccagcccggacugacuucugcagugaucgacgccuugccucggaauaugguuauuacaugucagggcucagaugacauccgaaaacuccuggaaagucagggucgcaaggauauaaaauuaauugacaucgcucugagcaagaccgauuccagaaaauaugagaacgcggugugggaccaauacaaggaucuaugccacaugcauacgggggucgugguagagaagaaaaagaggggcggaaaagaagagaucaccccacacugugcacucauggacugcauuauguucgaugccgcuguuucuggcgggcugaauacaucggugcuucgggccgucuugccccgcgacaugguguuuagaacuagcaccccuagggucgugcuguga

SEQ ID NO: 1723 - RNA, 1710 nt, Artificial Sequence
  derived and/or modified CDS sequence (opt3) from Lassa virus__AIT17173__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccgcgcuggucgagacgggguggucagagugugggauguaaagaaugcagagcuucugaacaaucaguucggaacuaugccuaguuugacccucgccugucugacaaaacagggccaaguugacuuaaacgaugcugugcaggcccugaccgaccucggccuuaucuacacugcgaaguauccaaauacaagcgaccuggauagguugacccagucucauccgauucuaaacaugaucgacacgaagaaauccucacugaauauaagcggguacaacuuuagucucggagcagccgucaaggcuggugccugcaugcuggauggcgggaacaugcuugaaacuaucaaagugucuccccaaaccauggacggcauucugaaguccaucuugaaagugaagaaagcacucggaauguucauuagcgaugcuccuggugagcggaauccauaugaaaacauccuguacaagauauguuuaucgggggacggauggcccuauauugccucucguacauccaucacuggccgcgcgugggagaauaccgucguugaucuggagucagacggcaagccucagaaagccgggaguaacggaagcaauaagucccuacagucugcagguuuuacagcuggccucaccuacagccagcugaugacgcuuaaagaugccauguugcaacuggacccaaacgcuaagacuuggauggauauugaagggagacccgaggacccuguggaaaucgcccucuaccagccaucaaguggaugcuauauccacuucuuuagggagccgacagaccugaaacaguucaagcaggaugcaaaguacucccauggcauugacguaaccgaucuuuuugccgcucaacccggucugacuagcgcggugauagacgcauugccucggaauauggucaucacaugucaggggucugaugacauucgaaaacucuucgaaucacagggccgcaaggauaucaaacugauagacauugccuuaaguaagaccgauagcagaaaauaugagaacgcugugugggaccaguacaaggaucugugccacaugcauacgggaaucguuguggagaagaaaaagaggggcgggaaagaagagaucaccccacacugugcccuaauggacugcauuauguuugaugcagccgucuccggaggucucaauacaucugugcugcgggcuguacuuccccgcgacaugguuuucagaacuucgaccccuaggguggucuuguga

SEQ ID NO: 1724 - RNA, 1710 nt, Artificial Sequence
  derived and/or modified CDS sequence (opt3) from Lassa virus__AIT17177__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauaacgaccucaaaagacugagggaucuuaaucaagccguaaacaaucugguggaauugaagucgacacagcagaagucaguccuccgggugggaacucugacgagcgacgaucugcucguuuuagcggcugaccuggagaaacuuaagaguaaagugauacgcaccgaaagacccuuguccgccgguaucuauaugggcaaccugucuagccagcaacuagaucagaggcgggcacuccugaauaugauugggauguccggaggcaaccagggugcccgcgcugggcgagacggagucgugagaguaugggauguuaagaaugcagaccuucugaacaaucaguucggcacaaugccuucauugacucucgccugucugaccaaacaaggccagguggauuuaaacgacgucgugcaggcucugacagaccucgggcuuaucuacaccgccaaguauccaaauacaagugaucuggacagguugacucaaagccauccgauucuaaagaugaucgaugcgaacaaaucuucccugaauauaucaggauacaacuuuagccucggugcagccgugaaggcuggcgccugcaugcuggacgggggaaacaugcuugagaccaucaaagucaguccccagacgauggauggcauucugaagucuaucuugaaaguuaagaaaucccucgguauguucauuagcgacacuccuggggagcggaauccauaugaaaacauccuguacaagauauguuuaucgggagauggcuggcccuauauugcaucucguaccuccaucauuggccgcgcuugggagaauacagugguagaccuggaaucagaugggaagccucagaaaacuggaaguaacaauagcuccaagucucuacagagcgccgguuuugcggccggccucaccuacucacaacugaugacacuuaaagacgcaauguugcagcuggauccaaacgcuaagaccuggauggacaucgaggggagacccgaggacccuguggaaaucgcccucuaccagccaaguuccggaugcuauauucacuucuuuagggagccgacggaucugaaacaguucaagcaagacgcuaaguacagccauggcauagaugucacugaccuuuuugccgcacagcccggucugacaucugccgugaucgaggcuuugccucggaauaugguuauuaccugucaggggucagaugacauccgaaaacuccuggaaagucagggccgcaaggauauaaaauuaauugacaucgcgcugagcaagacugauuccagaaaauaugaaaacgcagugugggaccaauacaaggaucuaugccacaugcauacaggaaucgucguggagaagaaaaagaggggcgggaaagaggaaauuaccccacacugugcccucauggacugcaucauguucgaugcugccguaucuggaggucugaauacgcuuguuuugcgggcagugcugccccgcgacauggucuuuagaaccucgacaccuaaggugguccucuga

SEQ ID NO: 1725 - RNA, 1710 nt, Artificial Sequence
  derived and/or modified CDS sequence (opt3) from Lassa virus__AIT17181__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagcgacgugacgauaacgaccucaaaagacugagggaucuuaaucaagccgugaacaaucuggucgaauugaagucgacacagcagaagucagugcuccggguuggaacucugacgagcgacgaucugcucguguuagcggcugaccuggagaaacuuaagaguaaagucauucgcaccgaaagacccuuguccgccgguguguauaugggcaaccugucuagccagcaacuagaucagaggcgggcacuccugaauaugauagggauguccggaggcauccaggguacacgcacugggcgagacggaguaguuagagugugggaugucaagaacgccgaccuucugaauaaccaguucggcaccaugccuucauugacacucgcuugucugaccaaacaaggccagguggauuuaaaugacgugguccaggcacugacugaccucgggcuuauuuacacagccaaguauccaaacgcuagugaucuggacagguugacccaaagccauccgauccuaaauaugauugauacgaagaaaucuucccugaacaucucaggauacaauuuuagccucggugccgcgguuaaggcaggcgccugcaugcuggacgggggaaacaugcuugagacuauaaaagugaguccccagaccauggauggcauccugaagucuauuuugaaaguaaagaaaacacucgguauguucaucuccgacacuccuggggagcggaacccauaugaaaauauucuguacaagaucuguuuaagcggagauggcuggcccuauauagcuucgcguaccucuauuacaggccgcgccugggagaacaccguggucgaccuggaauccgaugggaagccucagaaagcaggaucaaauaacaguaauaagagccuacaguccgcugguuuugccgcgggccucacguacucucaacugaugacucuuaaagacgccauguugcagcuggauccaaacgcaaagacauggauggacaucgaggggagacccgaggacccuguggaaauugcucucuaccagccaagcucaggaugcuauauccacuucuuuagggagccgaccgaucugaaacaguucaagcaagacgccaaguacagucauggcaucgauguuacugaccuuuuugcugcccagcccggucugacauccgcagugauugaagccuugccucggaauauggucauaaccugucaggggagcgaugacaucaaaaagcuccuggagucucagggccgaaaagauauuaaguuaaucgacauagcucugucaaaaacggauagucgcaaguaugaaaacgcggugugggaccaauacaaggaucuaugccacaugcauaccggaguaguuguggagaaaaagaaaagaggcgggaaggaggaaauuacaccacacugugcacucauggacugcaucauguucgaugccgcugucagcggaggucugaauacucuuguguugagggccguccugccccgggacaugguguuucgcaccuccacaccuagaguugugcucuga

SEQ ID NO: 1726 - RNA, 1710 nt, Artificial Sequence
  derived and/or modified CDS sequence (opt3) from Lassa virus__AIT17185__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauggagaccucaaaagacugagggaucuuaaccaagccguaaauaaccugguggaauugaagucgacacagcagaagucaguccuccggguggguacucugacgagcgacgaucugcucauauuagcggcugaccuggagaaacuuaagaguaaaguuacccgcacagaaagacccuuguccgccggcguguauauggggaaucugucuagccagcaacuagaucagaggcgggcacuccugaacaugaucggaauguccggcgguaaucgcggggcccgaacuggaaaggacggcgucgugagaauuugggauguuaaaaacgcugaccuucugaauaaccaguucggcaccaugccuucauugacacucgcaugucugaccaagcaggggcaaguagauuuaaaugacgugguccaggcccugacugaccucggacuuaucuacacagcuaaguauccaaacaccagugaucuggacagguugacgcagagccauccgauucuaaauaugaucgauacuaacaaaucuucccugaauauaucagguuacaacuuuagccucggcgccgcggugaaggcaggggccugcaugcuggacggaggcaacaugcuugagaccaucaaagugaguccccaaacaauggaugguauucugaagucuaucuugaaagucaagaaaucccucgggauguucauuagcgacacuccuggagagcggaauccauaugaaaacauccuguacaagauauguuuaucgggcgauggcuggcccuauauugcuucucguaccuccaucacagggcgcgccugggagaauaccguuguggaccuggaaucagaugagaagccucagaaagcaggaaguaacaauagcaacaagucccuacagucuacggguuuuacugcuggccucacauacagccagcugaugacccuuaaagacgccauguugcaacuggauccaaaugcgaagacuuggauggacauugaggggagacccgaagacccuguagagaucgcccucuaccagccaucaaguggaugcuauauccacuucuuuagggaaccgacagaucugaaacaguucaagcaggacgcaaaguacucccauggcauugaugugaccgaccuuuuugcugcccaacccggucugacgagcgcugucauagauaccuugccucggaacauggugaucacaugucaggggucugacgauauucgaaaacuccuggagucacagggccgcaaggacaucaaauuaauagauauugcccugaguaagacugacagcagaaaauaugaaaaugcaguuugggaucaguacaaggaccuaugccacaugcauaccggaguggucguggagaagaaaaagaggggcgggaaagaggaaaucacaccacacugugcccucauggauugcaucauguucgacgcugcgguauccggaggucugaacgcaucuguucuucgggccguguugccccgcgacauggucuuuagaacuucgaccccuagggugguccuguga

SEQ ID NO: 1727 - RNA, 1710 nt, Artificial Sequence
  derived and/or modified CDS sequence (opt3) from Lassa virus__AIT17189__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuacccgcacagagagacccuuguccgccgguguguauaugggcaaccugucuagccagcagcuagaucaaaggcgggcacuccuguccaugaucgggaugucaggaggcaaucagggugcccgcacugggcgagacggagucgugagaguaugggauguuaagaacgcugagcuucugaauaaccaguucggcaccaugccuaguuugacacucgcaugucugaccaaacagggccaaguggacuuaaaugaugucgugcaggcccugacugaccucgggcuuauuuacacagcuaaguauccaaacaccagcgaccuggauagguugacgcagucucauccgauccuaaauaugauugacacuaagaaauccucacugaacaucagcggauacaauuuuagucucggugccgcggugaaggcaggcgccugcaugcuggaugggggaaacaugcuugaaaccauaaaagucucuccccaaacaaucgacggcauucugaaguccaucuugaaaguuaagaaagcucucgguauguucauuagcgauacuccuggggagcggaacccauaugaaaauauccuguacaagauauguuuaucgggagacggcuggcccuauauugccucucguaccuccaucacaggccgcgcaugggagaacaccgugguagaucuggagucagacgggaagccucagaaagcuggaaguaauaacagcaauaagucccuacagucugccgguuuuacggcgggccucacuuacagccagcugaugacacuuaaagaugccauguugcaacuggacccaaacgcaaagaccuggauggauauugaagggagacccgaggacccuguggaaaucgcucucuaccagccaucaaguggaugcuauauccacuucuuuagggagccgacugaccugaaacaguucaagcaggaugccaaguacucccauggcauugacgucacagaucuuuuugcugcccaacccggucugaccagcgcagugauagacgccuugccucggaauaugguuaucacgugucaggggucugaugacauucgaaaacuccuggaaucacagggccgcaaggauaucaaauuaauagacauugcucugaguaagaccgauagcagaaaauaugagaacgcggugugggaccaguacaaggaucuaugccacaugcauacaggagucgugguagagaagaaaaagaggggcgggaaagaagagaucacuccacacugugcacucauggacugcaucauguucgaugccgcuguuuccggaggucuuaauucucugguguugcgggccguccugccccgcgacaugguguuuagaaccucgacaccuagggucgugcucuga

SEQ ID NO: 1728 - RNA, 1710 nt, Artificial Sequence
  derived and/or modified CDS sequence (opt3) from Lassa virus__AIT17193__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuacccgcacagagagacccuuguccgccgguguguauaugggcaaccugucuagccagcagcuagaucaaaggcgggcacuccuguccaugaucgggaugucaggaggcaaucagggugcccgcacugggcgagacggagucgugagaguaugggauguuaagaacgcugagcuucugaauaaccaguucggcaccaugccuaguuugacacucgcaugucugaccaaacagggccaaguggacuuaaaugaugccguccaggcucugacugaccucgggcuuauuuacacagccaaguauccaaacaccagcgaccuggauagguugacgcagucucauccgauccuaaauaugauugacacuaagaaauccucacugaacaucagcggauacaauuuuagucucggugcggcagugaaggccggcgcuugcaugcuggaugggggaaacaugcuugaaaccauaaaagugucuccccaaacaauggacggcauccugaaguccauuuugaaagucaagaaagcccucgguauguucaucagcgauacuccuggggagcggaacccauaugaaaauauucuguacaagaucuguuuaucgggagacggcuggcccuauauagcaucucguaccuccauuacaggccgcgcuugggagaacaccguuguggaucuggagucagacgggaagccucagaaagccggaaauaacaauaguaacaagagccuacaguccgcggguuuuacggccggccucacuuacucucagcugaugacacuuaaagaugcaauguugcaacuggacccaaaugcuaagaccuggauggauaucgaagggagacccgaggacccuguagaaauugcccucuaccagccaagcucaggaugcuauauccacuucuuuagggagccgacugaccugaaacaguucaagcaggaugcuaaguacagucauggcaucgacgugacagaucuuuuugccgcacaacccggucugaccuccgccgucauugacgcuuugccucggaacauggugauaacgugucaggggagcgaugacauccgaaaacuccuggaaucucagggccgcaaggauauuaaauuaaucgacauagcgcugucaaagaccgauaguagaaaauaugagaaugcaguuugggaccaguacaaggaucuaugccacaugcauacaggaguggucguggagaagaaaaagaggggcgggaaagaagagauuacuccacacugugcccucauggacugcaucauguucgaugcugccguaagcggaggucugaacucccuuguuuugcgggcagugcugccccgcgacauggucuuuagaaccucuacaccuagggugguccucuga

SEQ ID NO: 1729 - RNA, 1710 nt, Artificial Sequence
  derived and/or modified CDS sequence (opt3) from Lassa virus__AIT17197__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucucuacagcagcucgaucaaaggcgggcacugcuuaauaugaucgggaugagcggauccaaccagggcgugcgcgccggucgagacggggucgugagaguaugggauguuaagaaugcugagcuguugaacaaucaguucggaacaaugccuucacucacucuggcauguuuaaccaaacagggccaaguggaccugaacgaugccguccaggcucucacagaccuuggccugauuuacaccgccaaguauccaaauacaagugacuuggauaggcuaacucagagccauccgauccugaacaugauagacaccaagaaaucuucccucaauaucucaggguacaacuuuagccugggagcggcagugaaggccggugcuugcaugcuugauggcgggaacaugcuggaaacgauuaaagugaguccccaaacuauggacggaaucuugaagucuauucucaaagucaagaaagcccugggcauguucaucuccgauaccccuggugagcggaauccauaugaaaacauauuauacaagauuugucugagcggggacggauggcccuauaucgcaucgcguacaucuauuacuggccgcgcuugggagaauaccguuguggaucuagaguccgacggcaagccucagaaagccgggucaaacggaaguaauaagagccuccaguccgcggguuuuacagccggccugaccuacucucagcuuaugacguugaaagaugcaaugcugcaacucgacccaaacgcuaagacuuggauggauaucgaagggagacccgaggacccuguagaaaucgcccuguaccagccaagcucaggaugcuauauucacuucuuuagggagccgacagaccuuaaacaguucaagcaggaugcuaaguacagucauggcauagacgugaccgaucuguuugccgcacaacccgguuugacuuccgccgucaucgacgcucucccucggaauauggugauuacaugucaggggagcgaugacauccgaaaacuguuagaaucucagggccgcaaggauauaaaacugauugacaucgcgcuaucaaagaccgauaguagaaaauaugagaacgcaguuugggaccaguacaaggaucucugccacaugcauacgggaaucguggucgagaagaaaaagaggggcgggaaagaagagauuaccccacacugugcccugauggacugcaucauguucgaugcugccgugagcggaggucuuaauacauccguauugcgggcaguucugccccgcgacaugguguuuagaacuucuaccccuagggucgugcucuga

SEQ ID NO: 1730 - RNA, 1710 nt, Artificial Sequence
  derived and/or modified CDS sequence (opt3) from Lassa virus__AIT17201__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccgcgcuggucgagacgggguggucagagugugggauguaaagaaugcagagcuucugaacaaucaguucggaacuaugccuaguuugacccucgccugucugacaaaacagggccaaguugacuuaaacgaugcugugcaggcccugaccgaccucggccuuaucuacacugcgaaguauccaaauacaagcgaccuggauagguugacccagucucauccgauucuaaacaugaucgacacgaagaaauccucacugaauauaagcggguacaacuuuagucucggagcagccgucaaggcuggugccugcaugcuggauggcgggaacaugcuugaaacuaucaaagugucuccccaaaccauggacggcauucugaaguccaucuugaaagugaagaaagcacucggaauguucauuagcgaugcuccuggugagcggaauccauaugaaaacauccuguacaagauauguuuaucgggggacggauggcccuauauugccucucguacauccaucacuggccgcgcgugggagaauaccgucguugaucuggagucagacggcaagccucagaaagccgggaguaacggaagcaauaagucccuacagucugcagguuuuacagcuggccucaccuacagccagcugaugacgcuuaaagaugccauguugcaacuggacccaaacgcuaagacuuggauggauauugaagggagacccgaggacccuguggaaaucgcccucuaccagccaucaaguggaugcuauauccacuucuuuagggagccgacagaccugaaacaguucaagcaggaugcaaaguacucccauggcauugacguaaccgaucuuuuugccgcucaacccggucugacuagcgcggugauagacgcauugccucggaauauggucaucacaugucaggggucugaugacauuaaaaagcuguucgaaucacagggccgaaaagauaucaagcucauagacauugccuuaaguaaaaccgauagccgcaaguaugagaacgcugugugggaccaguacaaggaucugugccacaugcauacgggaaucguuguggagaaaaagaaaagaggcgggaaggaagagaucaccccacacugugcccuaauggacugcauuauguuugaugcagccgucuccggaggucucaauacaucugugcugagggcuguacuuccccgggacaugguuuuccgcacuucgaccccuagaguggucuuguga

SEQ ID NO: 1731 - RNA, 1710 nt, Artificial Sequence
  derived and/or modified CDS sequence (opt3) from Lassa virus__AIT17205__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggaaggcacuccugaauaugauugggauguccggaucaaaccagggcgcccggaucggucgcgacggggugguccgagugugggauguuaaaaaugcugagcuucugaacaaucaguucggaacuaugccuaguuugacccucgcaugucugacaaagcagggccaaguagacuuaaacgaugccgugcaggcucugaccgaccucggccuuauuuacacugccaaguauccaaauacaagcgaccuggauagauugacccagucucauccgauccuaaacaugauagacacgaaaaaguccucacugaauaucagcggguacaacuuuagucucggagcggcagucaaagccggugcuugcaugcuggauggcgggaacaugcuugaaacuauuaaggugucuccccaaaccauggacggaauccugaaauccauuuugaaggugaaaaaggcccucggcauguucaucagcgauacaccuggugagaggaauccauaugaaaacauacuguacaagauuuguuuaucgggggacggauggcccuauaucgcaucucggacuuccauuaccggccgugcuugggagaauacagucguugaucuggagucagacggcaaaccucagaaggccgggaguaacagcuccaauaaaucucuacagagcgcgggacucaccgccggucugacguacucacagcuuaugacuuugaaggaugcaaugcugcaacucgacccaaacgcuaaaacauggauggauaucgaaggccgccccgaggacccuguggaaaucgcccuguaccagccaaguuccgggugcuauauucacuuuuucagagagccgaccgaccuuaagcaguuuaagcaggaugcuaaauacagccauggaauagacguaacugaucuguucgccgcacaacccggcuugacaucugccgugaucgacgcucucccuaggaaucuggucauuaccugucaggguucagaugacauccggaaguuacuggaaagucaggggcgaaaagauauaaagcuaauugacaucgcgcucagcaaaacggauucccgcaaguaugagaacgcagugugggaccaguacaaggaucugugccacaugcauaccggcaucguuguggagaaaaagaaaagaggaggcaaggaagagauuacaccacacugugcccuuauggacugcaucauguuugaugcugccgucucugggggauugaaugcaucggugcugagggccguacucccccgggacaugguuuuccgcacuagcaccccuagagugguccuguga

SEQ ID NO: 1732 - RNA, 1710 nt, Artificial Sequence
  derived and/or modified CDS sequence (opt3) from Lassa virus__AIT17209__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccuguccaugauugggaugucaggaggcaaucagggugcccgcgcugggcgagacggaguggucagagugugggauguaaagaacgcagagcuucugaauaaccaguucggcacuaugccuaguuugacccucgccugucugacaaaacagggccaaguugacuuaaaugaugugguccaggcucugaccgaccucgggcuuaucuacacugccaaguauccaaacacaagcgaccuggauagguugacccagucucauccgauucuaaauaugaucgacacgaagaaauccucacugaacauaagcggauacaauuuuagucucggugcggcagugaaggccggcgcuugcaugcuggaugggggaaacaugcuugaaacuaucaaagugucuccccaaaccauggacggcauucugaaguccaucuugaaagucaagaaagcccucgguauguucauuagcgauacaccuggggagcggaacccauaugaaaauauccuguacaagauauguuuaucgggagacggcuggcccuauauugcaucucguacuuccaucaccggccgcgcuugggagaacacaguuguggaucuggagucagacgggaagcuacagaaaaccggaaguaauaacagcaauaagucccuccagucugccgguuuuacggcgggccugacuuacagccagcuuaugacauugaaagaugccaugcugcaacucgacccuaacgcaaagauuuggauggauaucgaagggagaccagaggaccccguagaaaucgcucuguaccagccuucaaguggaugcuauauucacuucuuuagggagccaaccgaccuuaaacaguucaagcaggaugccaaguacucccauggcauagacgugacugaucuguuugcugcccaaccggguuugacaagcgcagucaucgacgcccucccccggaauauggugauuaccugucaggggucugaugacauccgaaaacuguuagaaucacagggccgcaaggauauaaaacugauugacaucgcucuaaacaagacggauaguagaaaauaugagaaugcgguuugggaccaguacaaggaucucugccacaugcauaccggaguggucguggagaagaaaaagaaaggcgggaaggaagagaucacaccucacugugcacugauggacugcauuauguucgaugccgcuguaagcggaggucuuaacacuuccguuuugagggccgugcugccacgggacauggucuuucgcaccucuacacccagagugguccucuga

SEQ ID NO: 1733 - RNA, 1710 nt, Artificial Sequence
  derived and/or modified CDS sequence (opt3) from Lassa virus__AIT17211__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaggcaaccagggugcccaggcugggcgcgacggagugguccgagugugggauguaaagaaugcagagcuucugaacaaucaguucggcacuaugccuucauugacccucgccugucugacaaaacaaggccagguugacuuaaacgaugcugugcaggcccugaccgaccucgggcuuaucuacacugcgaaguauccaaauacaagugaccuggauagauugacccaaagccauccgauucuaaacaugaucgacacgaagaaaucuucccugaauauaucaggauacaacuuuagccucggugcagccgucaaggcuggcgccugcaugcuggaugggggaaacaugcuugaaacuaucaaagugaguccccagaccauggacggcauucugaagucuaucuugaaagugaagaaagcacucgguauguucauuuccgauacaccuggggagaggaauccauaugaaaacauccuguacaagauauguuuaagcggagacggcuggcccuauauugcuucgcggacuucuaucaccggccgugccugggagaauacagucguugaucuggaguccgacgggaagccucagaaagcgaacucaaauaguagcaacaagucccuacagucugccggauuuaccgcaggucucacguacagccaacugaugacucuuaaagaugcuauguugcagcuggacccaaaugccaagacauggauggauauugaaggccgccccgaggacccuguggaaaucgcucucuaccagccaucaagugggugcuauauccacuucuuuagagagccgaccgaccugaaacaguucaagcaagaugccaaguacucccauggaauugacguaacugaucuuuuugcagcccagcccggccugacaagcgcugugauagacgcguugccuaggaacauggucaucaccugucaggguucugaugacauucggaaacuccuggaaucacaggggcgaaaggauaucaaauuaauagacauugcacugaguaagacggauagccgcaaauaugagaaugccgugugggaccaauacaaggaucuaugccacaugcauaccggcaucguuguggagaagaaaaagagaggaggcaaagaagagaucacaccacacugugcucucauggacugcauuauguucgaugccgcagucuccgggggacugaacacuucugugcuuagggccguauugccccgggacaugguuuuucgcaccucgacaccuagagugguccuguga

SEQ ID NO: 1734 - RNA, 1710 nt, Artificial Sequence
  derived and/or modified CDS sequence (opt3) from Lassa virus__AIT17213__NP
augagcgccuccaaggagaucaaaucuuuccuguggacccagucacucagaagggaacuugcuggcuacugcaguaacauuaagcugcaaguggucaaagacgcacaggccuuguuacacgggcuggauuuuagcgagguuuccaaugugcagcggcuaaugcgcaaggaacgacgugacgauaacgaccucaaaagacugagggaucuuaaucaggcgguaaacaaucugguggaguugaagucuacacaacagaagucgguccuccgggugggaacucugacgucagacgaucugcucauauuagcugccgaccuggaaaaacuuaagagcaaaguuauccgcaccgagagacccuugagugcaggaguguauaugggcaaccuguccucucagcagcuagaucaaaggcgggcccuccugaauaugauugggaugagcggauccaaccagggcguccgcgcuggucgagacggggugguaagaguuugggaugugaagaaugcagagcuucugaacaaucaguucggaacaaugccuucauugacucucgccugucugaccaaacagggccaagucgacuuaaacgaugcugugcaggcccugacagaccucggccuuaucuacaccgcgaaguauccaaauacaagugaccuggauagguugacucagagccauccgauucuaaacaugaucgacaccaagaaaucuucccugaauauaucaggguacaacuuuagccucggagcagccgugaaggcuggugccugcaugcuggauggcgggaacaugcuugaaacgaucaaagucaguccccaaacuauggacgguauucugaagucuaucuugaaaguuaagaaagcacucggcauguucauuuccgauaccccuggugagcggaauccauaugaaaacauccuguacaagauauguuuaagcggggacggauggcccuauauugcuucgcguacaucuaucacuggccgcgccugggagaauaccgugguagaucuggaguccgacggcaagccucagaaagcggggucaaacggaaguaauaagagccuacaguccgccgguuuuacagcaggccucaccuacucucagcugaugacgcuuaaagaugcuauguugcaacuggacccaaacgccaagacuuggauggauauugaagggagacccgaggacccuguggaaaucgcucucuaccagccaagcucaggaugcuauauccacuucuuuagggagccgacagaccugaaacaguucaagcaggaugccaaguacagucauggcauugacgucaccgaucuuuuugcagcccaacccggucugacuuccgcugugauagacgcguugccucggaauaugguuaucacaugucaggggagcgaugacauucgaaaacuccuggaaucucagggccgcaaggauaucaaauuaauagacauugcacugucaaagaccgauaguagaaaauaugagaacgccgugugggaccaguacaaggaucuaugccacaugcauacgggaaucgucguggagaagaaaaagaggggcgggaaagaagagaucaccccacacugugcucucauggacugcauuauguucgaugccgcaguaagcggaggucugaauacauccguucuucgggccguguugccccgcgacauggucuuuagaacuucuaccccuagggugguccuguga

SEQ ID NO: 1735 - RNA, 1710 nt, Artificial Sequence
  derived and/or modified CDS sequence (opt3) from Lassa virus__AIT17217__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccuguccaugauugggaugucaaguggagugcagggcgcccgcgcuggucgagacggggucgugagaguaugggauguuaagaaugcagagcuucugaacaaucaguucggaacuaugccuagcuugacccucgccugucugacaaaacagggccaaguggacuuaaacgaugucgugcaggcucugaccgaccucggccuuaucuacacugccaaguauccaaauacaucugaccuggauagguugacccagucccauccgauucuaaacaugaucgacacgaagaaaucaagccugaauauaaguggguacaacuuuucucucggagcggcagugaaggccggugcuugcaugcuggauggcgggaauaugcuugaaacuaucaaagucagcccccaaaccauggacggaauuuugaaguccauccugaaaguuaagaaagcccucggcauguucauuucggagacaccuggugaacggaacccauaugagaacauccuguacaagauauguuuaucuggggauggauggcccuauauugcaucccguacuucaaucaccggccgcgcuugggagaauacagugguagaccuggaaagugauggcaagccucagaaagccgggagcaacaauuccaacaagucucuacagagcaccggauuugcggccggucucacguacucacagcugaugacucuuaaagacgcaauguugcaacuggauccaaaugcuaagacauggauggacauugagggcagacccgaagauccuguggaggucgcccucuaccagccaaguuccgggugcuauauccacuucuuuagggaaccgaccgaccugaaacaguucaagcaggacgcuaaguacagccauggaaucgaugugacugaccuuuuugccgcacaacccggccugacaucugccguuauugaugcuuugccucggaacauggugauaaccugucaggguucagacgauaucaaaaagcuccuggagagucaggggcgaaaagacauuaaguuaaucgauauagcgcugagcaaaacggacucccgcaaguaugagaaugcagucugggaucaguacaaggaccuaugccacaugcauaccggcgugguaguugagaaaaagaaaagaggaggcaaggaagaaauuacaccacacugugcccucauggauugcaucauguucgacgcugccgugucugggggacugaacacuucgguccuuagggcaguguugccccgggauauggucuuucgcaccagcacaccuagagugguucuguga

SEQ ID NO: 1736 - RNA, 1710 nt, Artificial Sequence
  derived and/or modified CDS sequence (opt3) from Lassa virus__AIT17225__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauaacgaccucaaaagacugagggaucuuaaucaagccguaaacaaucugguggaauugaagucgacacagcagaagucaguccuccgggugggaacucugacgagcgacgaucugcucguuuuagcggcugaccuggagaaacuuaagaguaaagugacccgcacagaaagacccuuguccgccggugucuauaugggcaaccugucuagccagcaacuagaucagaggcgggcacuccugaauaugauagggauguccggaggcaaccagggugcccgcgcugggaaugacggagugguacgaguuugggaugugaagaacgcagaccuucugaauaaccaguucggcacuaugccuucauugacccucgccugucugacaaaacaaggccaggucgauuuaaaugacguggugcaggcucugaccgaccucgggcuuaucuacacugccaaguauccaaacacaagugaucuggacagauugacccaaagccauccgauucuaaauaugaucgauacgaagaaaucuucccugaacauuucaggauacaacuuuagccucggugcggcagucaaggccggcgcuugcaugcuggacgggggaaauaugcuugagacuaucaaaguuaguccccagaccauggauggcauacugaagucuaucuugaaagugaagaaagcccucgguauguucauuuccgacacaccuggggagaggaacccauaugaaaauauccuguacaagauuuguuuaagcggagauggcuggcccuauaucgcaucgcggacuucuauaaccggccgugcuugggagaacacaguaguggaccuggaauccgaugggaagccucagaaaaccggaaauaacucaaguaauaagagccuacaguccgccgguuuuacggcgggccucacuuacucucaacugaugacacuuaaagacgccauguugcagcuggauccaaacgcaaagaccuggauggacauugaggggcgccccgaggacccugucgaaguggcucucuaccagccaagcucaggaugcuauauccacuucuuuagagagccgacugaucugaaacaguucaagcaagacgccaaguacagucauggcauugauguuacagaccuuuuugcugcccagcccggucugaccuccgcagugaucgaagccuugccuaggaauauggucaucacgugucaggggagcgaugacauucggaaacuccuggagucucagggccgaaaggauauaaaauuaaucgacauugcucugucaaagaucgauagucgcaaauaugaaaacgcggugugggaccaauacaaggaucuaugccacaugcauaccggaguaguuguggagaagaaaaagagaggcgggaaagaggaaauaacaccacacugugcacucauggacugcauuauguucgaugccgcugucagcggaggucugaauacucuuguguugagggccguccugccccgggacaugguguuucgcaccuccacaccuaagguugugcucuga

SEQ ID NO: 1737 - RNA, 1710 nt, Artificial Sequence
  derived and/or modified CDS sequence (opt3) from Lassa virus__AIT17229__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuauccgcaccgagagacccuuguccgccgguguguauaugggcaaccugucuagccagcagcuagaucaaaggcgggcacuccuguccaugauugggaugucaggaggcaaucaggguacacgcgccgggcgagacggagucgugagaguaugggauguuaagaacgcugagcuucugaauaaccaguucggcacuaugccuaguuugacccucgcaugucugacaaaacagggccaaguggacuuaaaugaugccguccaggcucugaccgaccucgggcuuaucuacacugccaaguauccaaacacaagcgaccuggauagguugacccagucucauccgauucuaaauaugaucgacacgaagaaauccucacugaacauaagcggauacaauuuuagucucggugcggcagugaaggccggcgcuugcaugcuggaugggggaaacaugcuugaaacuaucaaagugucuccccaaaccauggacggcauucugaaguccaucuugaaagucaagaaagcccucgguauguucauuagcgauacaccuggggagcggaacccauaugaaaauauccuguacaagauauguuuaucgggagacggcuggcccuauauugcaucucguacuuccaucaccggccgcgcuugggagaacacaguuguggaucuggagucagacgggaagccucagaaagccggaaguaauaacagcaauaagucccuacagucugcggguuuuaccgccggccucacguacagccagcugaugacucuuaaagaugcaauguugcaacuggacccaaacgcuaagacauggauggauauugaagggagacccgaggacccuguagaaaucgcccucuaccagccaucaaguggaugcuauauccacuucuuuagggagccgaccgaccugaaacaguucaagcaggaugcuaaguacucccauggcauugacgugacugaucuuuuugccgcacaacccggucugacaagcgccgucauagacgcuuugccucggaauauggugaucaccugucaggggucugaugacauucgaaaacuccuggaaucacagggccgcaaggauaucaaauuaauagacauugcgcugaguaaggcagauagcagaaaauaugagaacgccguuugggaccaguacaaggaucuaugccacaugcauacgggaguggucguggagaagaaaaagaggggcgggaaagaagagaucaccccacacugugcucucauggacugcaucauguucgaugccgcaguauccggaggucugaauacaucuguucuucgggccguguugccccgcgacauggucuuuagaacuucgaccccuagggugguccuguga

SEQ ID NO: 1738 - RNA, 1710 nt, Artificial Sequence
  derived and/or modified CDS sequence (opt3) from Lassa virus__AIT17233__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaaggaacgacgugacgauaacgaccucaaaagacugagggaucuuaaucaggccgugaacaaucuggucgaguugaagucgacacaacagaagucaauucuccgggugggaacucugacgagcgacgaucugcucguuuuagcggcugaccuggaaaaacuuaagaguaaagugacccgcacagagagacccuuguccgccggugucuauaugggcaaccugucuagccagcagcuagaucaaaggcgggcacuccuguccaugauagggaugucaggaggcaaucagggugcccaggcugggcgcgacggagugguacgaguuugggaugugaagaacgcagagcuucugaauaaccaguucggcacuaugccuaguuugacccucgccugucugacaaaacaaggccaggucgacuuaaaugaugcugugcaggcccugaccgaccucgggcuuaucuacacugcgaaguauccaaacacaagcgaccuggauagauugacccaaucucauccgauucuaaauaugaucgacacgaagaaauccucacugaacauuagcggauacaauuuuagucucggugcagccgugaaggcuggcgccugcaugcuggaugggggaaacaugcuugaaacuaucaaagucucuccccagaccauggacggcauacugaaguccaucuugaaaguuaagaaagcacucgguauguucauuagcgauacaccuggggagaggaacccauaugaaaauauccuguacaagauuuguuuaucgggagacggcuggcccuauaucgcuucucggacuuccauaaccggccgugccugggagaacacagugguagaucuggagucagacgggaagccucagaaagcgggaaguaauaacagcaauaagucccuacagucugccgguuuuaccgcaggccucacguacagccaacugaugacucuuaaagaugcuauguugcagcuggacccaaacgccaagacauggauggauauugaagggcgccccgaggacccuguggaagucgcucucuaccagccaucaaguggaugcuauauccacuucuuuagagagccgaccgaccugaaacaguucaagcaagaugccaaguacucccauggcauugacgugacugaucuuuuugcagcccagcccggucugacaagcgcuguuaucgacgcguugccuaggaauauggugaucaccugucaggggucugaugacauucggaaacuccuggaaucacagggccgaaaggauauaaaauuaaucgacauugcacugaguaagacggauagccgcaaauaugagaacgccgucugggaccaauacaaggaucuaugccacaugcauaccggagugguaguugagaagaaaaagagaggcgggaaagaagagaucacaccacacugugcucucauggacugcauaauguucgaugccgcaguguccggaggucugaauacuucuguccuuagggccguguugccccgggacauggucuuucgcaccucgacaccuagagugguucuguga

SEQ ID NO: 1739 - RNA, 1710 nt, Artificial Sequence
  derived and/or modified CDS sequence (opt3) from Lassa virus__AIT17237__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccuguccaugauugggaugucaggaggcaaucagggugcccgcgcugggcgagacggaguggucagagugugggauguaaagaacgcagagcuucugaauaaccaguucggcacuaugccuaguuugacccucgccugucugacaaaacagggccaaguugacuuaaaugaugcugugcaggcccugaccgaccucgggcuuaucuacacugcgaaguauccaaacacaagcgaccuggauagguugacccagucucauccgauucuaaauaugaucgacacgaagaaauccucacugaacauaagcggauacaauuuuagucucggugcagccgucaaggcuggcgccugcaugcuggaugggggaaacaugcuugaaacuaucaaagugucuccccaaaccauggacggcauucugaaguccaucuugaaagugaagaaagcacucgguauguucauuagcgauacaccuggggagcggaacccauaugaaaauauccuguacaagauauguuuaucgggagacggcuggcccuauauugcuucucguacuuccaucaccggccgcgccugggagaacacagucguugaucuggagucagacgggaagccucagaaagcgggaaguaauaacagcaauaagucccuacagucugccgguuuuaccgcaggccucacguacagccagcugaugacucuuaaagaugcuauguugcaacuggacccaaacgccaagacauggauggauauugaagggagacccgaggacccuguggaaguagcucucuaccagccaucaaguggaugcuauauccacuucuuuagggagccgaccgaccugaaacaguucaagcaggaugccaaguacucccauggcaucgacgugacugaucuuuuugcagcccaacccggucugacaagcgcugucauugacgcguugccucggaauauggugauaaccugucaggggucugaugacauccgaaaacuccuggaaucacagggccgcaaggauauuaaauuaaucgacauagcacugaguaagacggauagcagaaaauaugagaacgccguuugggaccaguacaaggaucuaugccacaugcauaccggaguggucguggagaagaaaaagaggggcgggaaagaagagauuacaccacacugugcucucauggacugcaucauguucgaugccgcaguauccggaggucugaauacuucuguucuucgggccguguugccccgcgacauggucuuuagaaccucgacaccuagggugguccuguga

SEQ ID NO: 1740 - RNA, 1710 nt, Artificial Sequence
  derived and/or modified CDS sequence (opt3) from Lassa virus__AIT17241__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccuguccaugauugggaugucaggaggcaaucagggugcccgcgcugggcgagacggaguggucagagugugggauguaaagaacgcagagcuucugaauaaccaguucggcacuaugccuaguuugacccucgccugucugacaaaacagggccaaguugacuuaaaugaugcugugcaggcccugaccgaccucgggcuuaucuacacugcgaaguauccaaacacaagcgaccuggauagguugacccagucucauccgauucuaaauaugaucgacacgaagaaauccucacugaacauaagcggauacaauuuuagucucggugcagccgucaaggcuggcgccugcaugcuggaugggggaaacaugcuugaaacuaucaaagugucuccccaaaccauggacggcauucugaaguccaucuugaaagugaagaaagcacucgguauguucauuagcgauacaccuggggagcggaacccauaugaaaauauccuguacaagauauguuuaucgggagacggcuggcccuauauugcuucucguacuuccaucaccggccgcgccugggagaacacagucguugaucuggagucagacgggaagccucagaaagcgggaaguaauaacagcaauaagucccuacagucugccgguuuuaccgcaggccucacguacagccagcugaugacucuuaaagaugcuauguugcaacuggacccaaacgccaagacauggauggauauugaagggagacccgaggacccuguggaaaucgcucucuaccagccaucaaguggaugcuauauccacuucuuuagggagccgaccgaccugaaacaguucaagcaggaugccaaguacucccauggcauugacguaacugaucuuuuugcagcccaacccggucugacaagcgcugugauagacgcguugccucggaauauggucaucaccugucaggggucugaugacauucgaaaacucuucgaaucacagggccgcaaggauaucaaacugauagacauugcauuaaguaagacggauagcagaaaauaugagaacgccgugugggaccaguacaaggaucugugccacaugcauaccggaguuguggucgagaagaaaaagaggggcgggaaagaagagaucacaccacacugugcucuaauggacugcaucauguuugaugccgcaguguccggaggucucaauacuucuguacugcgggccguucuuccccgcgacaugguguucagaaccucgacaccuagggucguguuguga

SEQ ID NO: 1741 - RNA, 1710 nt, Artificial Sequence
  derived and/or modified CDS sequence (opt3) from Lassa virus__AIT17245__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccgcacuggucgagacgggguggucagagugugggauguaaagaaugcugagcuucugaacaaucaguucggaaccaugccuaguuugacacucgcaugucugaccaaacagggccaaguugacuuaaacgaugccgugcaggcucugacugaccucggccuuaucuacacagccaaguauccaaauaccagcgaccuggauagguugacgcagucucauccgauucuaaacaugaucgacacuaagaaauccucacugaauauaagcggguacaacuuuagucucggagcggcagucaaggccggugcuugcaugcuggauggcgggaacaugcuugaaaccaucaaagugucuccccaaacaauggacggcauucugaaguccaucuugaaagugaagaaagcccucggaauguucauuagcgauacuccuggugagcggaauccauaugaaaacauccuguacaagauauguuuaucgggggacggauggcccuauauugcaucucguaccuccaucacaggccgcgcuugggagaauaccgucguugaucuggagucagacggcaagccucagaaagccgggaguaacaauagcaacaagucccuacagucugcgggacucacggccggucugacuuacagccagcuuaugacauugaaagaugcaaugcugcaacucgacccaaaugcuaagaccuggauggauauugaaggcagacccgaggacccuguggaaaucgcccuguaccagccaucaagugggugcuauauccacuuuuucagggagccgacugaccuuaaacaguuuaagcaggaugcuaaguacucccauggaauugacguagccgaucuguucgcagcccaacccggcuugacaagcgcugugauagacgcgcucccucggaaccuggucaucaccugucaggguucugaugacauucgaaaauuacuggaaucacaggggcgcaaggauaucaaacuaauagacauugcacucaguaagacggauagcagaaaauaugagaaugccgugugggaccaguacaaggaucugugccacaugcauaccggcaucguuguggagaagaaaaagaggggaggcaaagaagagaucacaccacacugugcucuuauggacugcauuauguuugaugccgcagucuccgggggauugaacgccucugugcugcgggcuguacucccccgcgacaugguuuucagaacuucgaccccuagggugguccuguga

SEQ ID NO: 1742 - RNA, 1710 nt, Artificial Sequence
  derived and/or modified CDS sequence (opt3) from Lassa virus__AIT17247__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauucggaccucaaaagacugagggaucuuaaccaagccguaaauaaccugguggaauugaagucaacacagcagaaguccguccuccgggugggaacucugacgagugacgaucugcucauauuagcggcugaccuggagaaacuuaaguccaaaguuauccgcaccgaaagacccuugucuagcgguguguauaugggcaaucuguccucacagcaacuagaucagaggcgggcccuccugaacaugauugggaugaguggaggcaaucagggugcacaggucgggcgcgacggagugguacgaguuugggaugugaagaacgccgaccuucugaauaaccaauucggcacaaugccuagcuugacucucgcuugucugaccaaacagggccaggucgauuuaaaugacguggugcaagcacugacagaccucgggcuuaucuacaccgccaaguauccaaacacuucugaucuggacagauuggcucagucccauccgauucuaaauaugaucgauacaaagaaaucaagccugaacauaaguggauacaauuuuucucucggugccgcggucaaggcaggcgccugcaugcuggacgggggaaacaugcuugagaccaucaaaguuagcccccagacgauggauggcauucugaaaagcaucuugaaggugaagaaagcucucgguauguucauuucggagacuccuggggaaaggaacccauaugagaauauccuguacaagauauguuuaucuggagacggcuggcccuauauugccucccggaccucaaucacaggccgugcaugggaaaacacuauuguagaucuggagagugacgggaagccucagaaagcuggaagcaauaacuccaauaagucucuacaaagcgccgguuuuaccgcgggccucacauacucacagcugaugacccuuaaagauaguauguugcagcuggacccaaacgccaagacguggauggauaucgaggggcgccccgaagacccuguggaggucgcacucuaccagccauccagcggaugcuauauccacuucuuuagagaaccgacugaccugaaacaauucaagcaggaugcuaaguacucucauggcauugacgugacagaucuuuuugccgcucagcccggucugaccucagccguuauagaggcauugccuaggaauauggugaucacuugucaggggagugacgauauucggaaacuccuggaaagccaaggccgaaaggacaucaaauuaauagauauugcccugaacaagacagacucccgcaaauaugagaaugcugucugggaucaguacaaggaccuaugccacaugcauaccggagugguaguugagaagaaaaagagaggcgggaaagaagagaucacgccacacugugcgcucauggauugcaucauguucgacgcagccgugucuggaggucugaagacccuugucuugagggcugugcugccccgggauauggucuuucgcacaucgacuccuaaagugguucucuga

SEQ ID NO: 1743 - RNA, 1710 nt, Artificial Sequence
  derived and/or modified CDS sequence (opt3) from Lassa virus__AIT17251__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauucggaccucaaaagacugagggaucuuaaccaagccguaaauaaccugguggaauugaagucaacacagcagaaguccguccuccgggugggaacucugacgagugacgaucugcucauauuagcggcugaccuggagaaacuuaaguccaaaguuauccgcaccgaaagacccuugucuagcgguguguauaugggcaaucuguccucacagcaacuagaucagaggcgggcccuccugaacaugauugggaugaguggaggcaaucagggugcacaggucgggcgcgacggagugguacgaguuugggaugugaagaacgccgaccuucugaauaaccaauucggcacaaugccuagcuugacucucgcuugucugaccaaacagggccaggucgauuuaaaugacguggugcaagcacugacagaccucgggcuuaucuacaccgccaaguauccaaacacuucugaucuggacagauuggcucagucccauccgauucuaaauaugaucgauacaaagaaaucaagccugaacauaaguggauacaauuuuucucucggugccgcggucaaggcaggcgccugcaugcuggacgggggaaacaugcuugagaccaucaaaguuagcccccagacgauggauggcauucugaaaagcaucuugaaggugaagaaagcucucgguauguucauuucggagacuccuggggaaaggaacccauaugagaauauccuguacaagauauguuuaucuggagacggcuggcccuauauugccucccggaccucaaucacaggccgugcaugggaaaacacuauuguagaucuggagagugacgggaagccucagaaaaccggaagcaauaacuccaauaagucucuacaaagcgcugguuuuacagccggccucaccuacucacagcugaugacgcuuaaagauaguauguugcagcuggacccaaacgcgaagacuuggauggauaucgaggggcgccccgaagacccuguggaggucgcccucuaccagccauccagcggaugcuauauccacuucuuuagagaaccgacagaccugaaacaauucaagcaggaugcaaaguacucucauggcauugacgugaccgaucuuuuugcugcccagcccggucugacuucagcuguuauagaggccuugccuaggaauauggugaucacaugucaggggagugacgauauucggaaacuccuggaaagccaaggccgaaaggacaucaaauuaauagauauugcacugaacaagaccgacucccgcaaauaugagaaugccgucugggaucaguacaaggaccuaugccacaugcauacgggagugguaguugagaagaaaaagagaggcgggaaagaagagaucaccccacacugugcucucauggauugcaucauguucgacgcggcagugucuggaggucugaagacacuugucuugagggccgugcugccccgggauauggucuuucgcacuucgaccccuaaagugguucucuga

SEQ ID NO: 1744 - RNA, 1710 nt, Artificial Sequence
  derived and/or modified CDS sequence (opt3) from Lassa virus__AIT17255__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucguuuuagcggcugaccuggaaaaacuuaagaguaaagugacccgcacagagagacccuuguccgccggugucuauaugggcaaccugucuagccagcagcuagaucaaaggcgggcacuccuguccaugauagggaugucaggaggcaaucagcgcgcccaggcuggucgagacggggugguaagaguuugggaugugaagaacgcagagcuucugaauaaccaguucggaacuaugccuaguuugacccucgccugucugacaaaacaaggccaggucgacuuaaaugaugcugugcaggcccugaccgaccucggccuuaucuacacugugaaguauccaaacgcgagcgaccuggauagguugacacaaucucauccgauucuaaauaugaucgacaccaagaaauccucacugaacauuagcggguacaauuuuagucucggagcagccgucaaggcuggugccugcaugcuggauggcgggaacaugcuugaaacgaucaaaguuucuccccagacuauggacggaauacugaaguccaucuugaaagugaagaaaacccucggcauguucauuagcgauacaccuggugagcggaacccauaugaaaauauccuguacaagauuuguuuaucgggggacggauggcccuauaucgcaucucguacuuccauaaccggccgcgcuugggagaacacaguaguggaucuggagucaaauggcaagccucagaaagccgacaguaacagcuccaauaagucucuacagagcgcgggguuuaccgccggacucacguacucacaacugaugacucuuaaagaugcaauguugcagcuggacccaaacgcuaagacauggauggauauugaagguagacccgaggacccugucgaaaucgccuucuaccagccaaguuccggcugcuauauucacuuuuucagggagccgaccgaccucaaacaguuuaagcaagaugcuaaguacagccaugggaucgacgugacugaucuguucgccgcacagcccggacuuacaucugccguuaucgacgcucugccucggaauauggugauuaccugucagggcucagaugacauacgaaaauugcucgaaagucagggucgcaaggauaucaaacugauugacaucgcguuaagcaagacggauuccagaaaauaugagaacgcagucugggaccaauacaaggaucugugccacaugcauaccggggugguaguugagaagaaaaagaggggcggaaaagaagagauaacaccacacugugcccuaauggacugcauuauguuugaugcugccgugucuggcgggcucaauacucugguccuucgggcaguguugccccgcgacauggucuucagaaccucgacaccuagggugguucuguga

SEQ ID NO: 1745 - RNA, 1710 nt, Artificial Sequence
  derived and/or modified CDS sequence (opt3) from Lassa virus__AIT17259__NP
augagcgccuccaaggagaucaaaucuuuccuguggacccagucacucagaagggaacuuaguagcuacugcuccaacauuaagcugcaaguggucaaagacgcucaggcauuguuacacggccuggauuuuucugagguuucgaaugugcagcggcuaaugcgcaaggaacgacgugacgauaacgaccucaaaagacugagggaucuuaaucaggccguaaacaaucugguggaguugaagucaacacaacagaaguccauacuccgggucgggacucugacgagugacgaucugcucaucuuagcggcugaccuggaaaaacuuaaguccaaagugacccgcacagagagacccuugucugccggaguuuauauggguaaccugagcucccagcagcuagaucaaaggcgggcacuccugaauaugcuuggcaugucagggaguaaccagggagcccgcgcuggccgagacgguguggucagagugugggauguaaagaaugcagagcuguugaacaaucaguucgggacuaugccuagccucacccuggccuguuuaacaaaacagggacaaguugaccugaacgaugcugugcaggcccucaccgaccuuggccugauuuacacugcgaaguauccaaauacaucugacuuggauaggcuaacccagucccauccgauccugaacaugauugacacgaagaaaucaagccucaauaucaguggcuacaacuuuucucugggggcagccgucaaggcuggagccugcaugcuugaugguggcaacaugcuggaaacuauaaaagugagcccccaaaccauggacgggauccucaagagcauuuugaaagugaagaaagcacugggaauguucaucucggauacaccuggcgagcggaauccauaugaaaacauuuuauacaagaucugucugucuggugacggguggcccuauauagcuucccguacuucaauuaccggacgcgccugggagaauacagucguugaucuagagagugacggcaagccucagaaagcgggcagcaacuccucuaauaagagccuccagucagccggguuuaccgcaggacugacguacagucagcuuaugacuuugaaagaugcuaugcugcaacucgacccaaacgccaagacauggauggauaucgaagguagacccgaggacccuguggaaauugcucuguaccagccauccagcggcugcuauauccacuucuuuagggagccgaccgaccuuaaacaguucaagcaggaugccaaguacucucaugggaucgacguaacugaucuguuugcagcccaacccggauugacaucagcugugauugacgcgcucccucggaauauggucauaaccugucagggcagugaugacauccgaaaacuguuagaaagccagggucgcaaggauauuaaacugaucgacauagcacuauccaagacggauucuagaaaauaugagaacgccgugugggaccaguacaaggaucucugccacaugcauaccgggauuguuguggagaagaaaaagaggggcggaaaagaagagaucacaccacacugugcucugauggacugcaucauguucgaugccgcagucucgggcgggcuuaaugccagcguguugcgggcuguacugccccgcgacaugguuuuuagaacuuccaccccuagggugguccucuga

SEQ ID NO: 1746 - RNA, 1710 nt, Artificial Sequence
  derived and/or modified CDS sequence (opt3) from Lassa virus__AIT17263__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuauccgcaccgagagacccuuguccgccgguguguauaugggcaaccugucuagccagcagcuagaucaaaggcgggcacuccugaauaugauugggaugggaggcuccaaccagggugcccgcgcugggcgagacggagucgugagaguaugggauguuaagaaugcagagcuucugaacaaucaguucggcacaaugccuucauugacucucgccugucugaccaaacagggccaaguggacuuaaacgaugcuguccaggcccugacagaccucgggcuuaucuacaccgcgaaguauccaaauacaagugaccuggauagguugacucagagccauccgauucuaaacaugaucgacaccaagaaaucuucccugaauauaucaggauacaacuuuagccucggugcagccgugaaggcuggcgccugcaugcuggaugggggaaacaugcuugaaacgaucaaagugaguccccaaacuauggacggcauucugaagucuaucuugaaagucaagaaagcacucgguauguucauuuccgauaccccuggggagcggaauccauaugaaaacauccuguacaagauauguuuaagcggagacggcuggcccuauauugcuucgcguacaucuaucacuggccgcgccugggagaauaccguuguggaucuggaguccgacgggaagccucagaaagcgggaucaaacgguaguaauaagagccuacaguccgccggcuuuacagcagggcucaccuacucucagcugaugacgcuuaaagaugcuauguugcaacuggacccaaacacuaagacauggauggauauugaaggaagacccgaggacccuguagaaguggcccucuaccagccaagcucaggcugcuauauccacuucuuuagggagccgaccgaccugaaacaguucaagcaggaugcuaaguacagucaugguaucgacgucacugaucuuuuugccgcacaacccgggcugacauccgccgugauugacgcuuugccucggaauaugguuauaaccugucagggcagcgaugacauccgaaaacuccuggaaucucagggacgcaaggauauuaaauuaaucgacauagcgcugucaaagacggauaguagaaaauaugagaacgcagugugggaccaguacaaggaucuaugccacaugcauaccggcauugucguggagaagaaaaagaggggagggaaagaagagaucacaccacacugugcccucauggacugcaucauguucgaugcugccguaagcgguggccugaauacuuccguucuucgggcaguguugccccgcgacauggucuuuagaaccucuacaccuagggugguccuguga

SEQ ID NO: 1747 - RNA, 1710 nt, Artificial Sequence
  derived and/or modified CDS sequence (opt3) from Lassa virus__AIT17267__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuacccgcacagagagacccuuguccgccgguguguauaugggcaaccugucuagccagcagcuagaucaaaggcgggcacuccugaauaugaucgggauguccggaggcaaccagggugcccgcgcugggcgagacggagucgugagaguaugggauguuaagaaugcagagcuucugaacaaucaguucggcacuaugccuucauugacccucgccugucugacaaaacagggccaaguggacuuaaacgaugcuguccaggcccugaccgaccucgggcuuauuuacacugcgaaguauccaaauacaagugaccuggauagguugacccagagccauccgauccuaaacaugauugacacgaagaaaucuucccugaauaucucaggauacaacuuuagccucggugcagccgugaaggcuggcgccugcaugcuggaugggggaaacaugcuugaaacuauaaaagugaguccccaaaccauggacucuauccugaaguccauuuugaaagucaagaaagcacucggcauguucaucagcgauacaccuggugagcggaauccauaugaaaacauucuguacaagaucuguuuaucgggggacggauggcccuauauagcuucucguacuuccauuaccggccgcgccugggagaauacaguuguggaucuggagucagacggcaagccucagaaagcggggaguaacaauagcaacaagucccuacagucugccggauuugcagcuggucucaccuacagccagcugaugacgcuuaaagaugccauguugcaacuggacccaaaugcuaagacuuggauggauaucgaaggcagacccgaggacccuguagaaauugcccucuaccagccaucaagugggugcuauauccacuucuuuagggagccgacagaccugaaacaguucaagcaggaugcaaaguacucccauggaaucgacgugaccgaucuuuuugccgcucaacccggccugacuagcgcggucauugacgcauugccucggaacauggugauaacaugucaggguucugaugacauccgaaaacuccuggaaucacaggggcgcaaggauauuaaauuaaucgacauagcccugaguaagaccgauagcagaaaauaugagaaugcuguuugggaccaguacaaggaucuaugccacaugcauacgggcguggucguggagaagaaaaagaggggaggcaaagaagagauuaccccacacugugcccucauggacugcaucauguucgaugcagccguauccgggggacugaacacaucuguucuucgggcuguguugccccgcgacauggucuuuagaacuaccacaccuagggugguccuguga

SEQ ID NO: 1748 - RNA, 1710 nt, Artificial Sequence
  derived and/or modified CDS sequence (opt3) from Lassa virus__AIT17271__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaggcaaccagggugcccgcgcugggcgagacggaguggucagagugugggauguaaagaaugcagagcuucugaacaaucaguucggcacuaugccuucauugacccucgccugucugacaaaacagggccaaguugacuuaaacgaugcugugcaggcccugaccgaccucgggcuuaucuacacugcgaaguauccaaauacaagugaccuggauagguugacccagagccauccgauucuaaacaugaucgacacgaagaaaucuucccugaauauaucaggauacaacuuuagccucggugcagccgucaaggcuggcgccugcaugcuggaugggggaaacaugcuugaaacuaucaaagugaguccccaaaccauggacggcauucugaagacaaucuugaaagugaagaaagcacucgguauguucauuucugauacuccuggggagcggaauccauaugaaaacauccuguacaagauauguuuauccggagacggcuggcccuauauugcuagccguaccucgaucacaggccgcgccugggagaauaccgucguugaucuggagucugacgggaagccucagaaaacgggauccaacaauucaaacaagagucuacagagcgcggguuuugccgcaggccucacuuacucccagcugaugacacuuaaagaugcuauguugcaacuggacccaaaugccaagaccuggauggauauugaagggagacccgaggacccuguggaaaucgcucucuaccagccaucuagcggaugcuauauccacuucuuuagggagccgacugaccugaaacaguucaagcaggaugccaaguacucacauggcauugacguaacagaucuuuuugcagcccaacccggucugaccagugcugugauagacgcguugccucggaacauggucaucacgugucagggguccgaugacauucgaaaacuccuggaaagccagggccgcaaggauaucaaauuaauagacauugcacugucuaaggccgauucaagaaaauaugagaaugcugugugggaccaguacaaggaucuaugccacaugcauaccggaguuguggucgagaagaaaaagaggggcgggaaagaagagaucacaccacacugugcccucauggacugcaucauguaugaugcagccgugaguggaggucugagcacuuccguacuucgggcuguuuugccccgcgacaugguguucagaaccucuacaccuagggucgugcuguga

SEQ ID NO: 1749 - RNA, 1710 nt, Artificial Sequence
  derived and/or modified CDS sequence (opt3) from Lassa virus__AIT17275__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauggagaccucaaaagacugagggaucuuaaccaagccguaaauaaccugguggaauugaagucgacacagcagaagucaguccuccggguggguacucugacgagcgacgaucugcucaccuuagcggcugaccuggagaaacuuaagaguaaaguuacacgcacugaaagacccuuguccgccggcguguauauggggaaucugucuagccagcaacuagaucagaggcgggcacuccugaacaugauaggaauguccggcgguaaucagggggcccgcaccggaaaggacggcgucgugcgaaucugggauguuaaaaacgcugaccuucugaauaaccaguucggcacaaugccuucauugacccucgcaugucugacuaagcaagggcagguagauuuaaaugacgugguccaggcccugacagaccucggacuuauuuacaccgcuaaguauccaaacaucagugaucuggacagauuggcccaaagccauccgauucuaaaaaugaucgauacgucuaaguccucacugaauauaagcgguuacaacuuuagucucggcgcggcagugaaagccggggcuugcaugcuggacggaggcaauaugcuugagacugugaaggucucuccccagaccauggaugguauccugaaauccauuuugaagguuaaaaagagccucgggauguucaucucggacacaccuggagagaggaacccauaugaaaacauucuguacaagaucuguuuaucuggcgauggcuggcccuauauagccucccggacuucaauuaccgggcgugcaugggagaauacagugguagaccuggaaagugauggaaaaccucagaagguggguagcaacaauuccaacaaaucucuacagagcaccggcuuuacggcugggcucacuuacucacaacugaugacacuuaaggacgccauguugcagcuggauccaaaugcgaaaaccuggauggacaucgagggacgccccgaggacccugucgaaauugcccucuaccagccaaguuccggcugcuauauccacuucuuuagagagccgacugaucugaagcaguucaagcaagacgcaaaauacagccaugguaucgaugugacagaccuuuuugcugcccagcccgggcugaccucugcuguuauugauacguugccuaggaacauggugauaaccugucagggcucagacgauaucggaaagcuccuggaaagucagggccggaaagacauuaaguuaaucgauauagcccugagcaaaacagacucccgaaaguaugagaaugcagucugggaucaauacaaggaccuaugccacaugcauacuggggugguaguugagaaaaagaaacgcggagguaaggaagagauuaccccacacugugcccucauggauugcaucauguucgacgcugcggugucuggcgggcugaacgcaucgguccuuagagccguguugcccagggacauggucuuucggacaagcacuccucgcgugguucuguga

SEQ ID NO: 1750 - RNA, 1710 nt, Artificial Sequence
  derived and/or modified CDS sequence (opt3) from Lassa virus__AIT17277__NP
augagcgccuccaaggagaucaaaucuuuccuguggacccagucacucagaagggaacuuaguagcuacugcuccaacauuaagcugcaaguggucaaagacgcucaggcauuguuacacggccuggauuuuucugagguuucgaaugugcagcggcuaaugcgcaaggaacgacgugacgauaacgaccucaaaagacugagggaucuuaaucaggccguaaacaaucugguggaguugaagucaacacaacagaagaguauacuccgggucgggacucugacgagugacgaucugcucaucuuagcggcugaccuggaaaaacuuaaguccaaagugacccgcacagagagacccuugucugccggaguuuauauggguaaccugagcucccagcagcuagaucaaaggcgggcacuccugucaaugauuggcaugagugggagcaaucagggagcccgcgcuggccgagacgguguggucagagugugggauguaaagaacgcagagcuucugaauaaccaguucgggacuaugccuucuuugacccucgccugucugacaaaacagggacaaguugacuuaaaugaugcugugcaggcccugaccgaccucggccuuaucuacacugcgaaguauccaaacacauccgaccuggauagguugacccagucacauccgauucuaaauaugaucgacacgaagaaaagcagucugaacauaucuggcuacaauuuuucccucggggcagccgucaaggcuggagccugcaugcuggaugguggcaacaugcuugaaacuaucaaagugagcccccaaaccauggacgggauucugaagucgaucuugaaagugaagaaagcacucggaauguucauuucugauacaccuggcgagcggaacccauaugaaaauauccuguacaagauauguuuauccggugacggguggcccuauauugcuucacguacuagcaucaccggacgcgccugggagaacacagucguugaucuggagagcgacggcaagccucagaaagcgggcuccaauaacucuaauaagagccuacagucagccggguuuaccgcaggacucacguacagucagcugaugacucuuaaagaugcuauguugcaacuggacccaaacgccaagacauggauggauauugaagguagacccgaggacccuguggaaguagcucucuaccagccauccagcggcugcuauauccacuucuuuagggagccgaccgaccugaaacaguucaagcaggaugccaaguacucucaugggaucgacgugacugaucuuuuugcagcccaacccggacugacaucagcugucauugacgcguugccucggaauauggugauaaccugucagggcagugaugacauccgaaaacuccuggaaagccagggucgcaaggauauuaaauuaaucgacauagcacuguccaagacggauucuagaaaauaugagaacgccguuugggaccaguacaaggaucuaugccacaugcauaccgggguggucguggagaagaaaaagaggggcggaaaagaagagauuacaccacacugugcucucauggacugcaucauguucgaugccgcaguaucgggcgggcugaauacuagcguucuucgggccguguugccccgcgacauggucuuuagaaccuccacaccuagggugguccuguga

SEQ ID NO: 1751 - RNA, 1710 nt, Artificial Sequence
  derived and/or modified CDS sequence (opt3) from Lassa virus__AIT17281__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauucggaccucaaaagacugagggaucuuaaccaggccguaaauaaccugguggaguugaagucaacacaacagaaguccguccuccgggugggaacucugacgagugacgaucugcucguuuuagcggcugaccuggaaaaacuuaaguccaaagugacccgcacagagagacccuugucugccggugucuauaugggcaaucugagcucccagcagcuagaucaaaggcgggcacuccugucaaugauagggaugaguggaggcaaccagggugcccgcgcugggcgagacggagugguaagaaucugggauguuaagaaugcagagcuucugaacaaucaguucggcacuaugccuagcuugacccucgccugucugacaaaacagggccaaguggacuuaaacgaugucgugcaggcucugaccgaccucgggcuuauuuacacugccaaguauccaaauacaucugaccuggauagguugacccagucccauccgauccuaaacaugauugacacgaagaaaucaagccugaauaucaguggauacaacuuuucucucggugcggcagugaaggccggcgcuugcaugcuggaugggggaaauaugcuugaaacuauaaaagucagcccccaaaccauggacggcauccugaaaagcauuuugaagguuaagaaagcccucgguauguucaucucggauacaccuggggagcggaacccauaugaaaacauucuguacaagaucuguuuaucuggagacggcuggcccuauauagcaucccguacuucaauuaccggccgcgcuugggagaauacaaucguggaucuggagagugacgggaagccucagaaaaccagcacgacuaacuccaauaagucucuacagagcgccggauuugcggccggucucacauacucacagcugaugacccuuaaagaugcaauguugcaacuggacccaaacgcuaagacuuggauggauauugaaggcagacccgaggacccuguagaaaucgcccucuaccagccaaguuccgggugcuauauccacuucuuuagggagccgacagaccugaaacaguucaagcaggaugcuaaguacagccauggaauugacgugaccgaucuuuuugccgcacaacccggccugacgucugccgucauagacaccuugccucggaauauggugaucacaugucaggguucagaagauauucgacgccuccuggagagucaggggagaaaagacaucaaguuaauagauauugcucugagcaaaacugacuccaggaaguaugagaacgcgguuugggaucaguacaaagaccuaugccacaugcauaccggcguggucguggaaaagaagaaaaagggaggcaaagaggaaaucacaccacacugugcacucauggauugcaucauguucgacgccgcuguaucugggggacugaauacuucgguucuucgggccguguugccccgcgauauggucuuuagaaccagcacaccuagggugguccuguga

SEQ ID NO: 1752 - RNA, 1710 nt, Artificial Sequence
  derived and/or modified CDS sequence (opt3) from Lassa virus__AIT17285__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggucgaugcgcaaggaacgacgugacgauaacgaccuaaaaagacucagggaucugaaucaggccguaaacaaucuuguggagcugaagucaacacaacagaaguccauauugcgggucggaacucucacgagugacgaucugcugauccucgcggcugacuuagaaaaacugaaguccaaagugacccgcacagagagaccccuuucugccgguguuuauaugggcaacuugagcucccagcagcuggaucaaaggcgggcacuacucaauaugauugggaugucaggaaguaaccagggcgcccgcgcuggucgagacgggguggucagagugugggauguaaagaaugcagagcugcuuaacaaucaguucggaacuaugccuagccugaccuuggccugucucacaaaacagggccaaguugaccugaacgaugugguccaggcuuuaaccgaccugggccucaucuacacugccaaguauccaaaugcgucugaccuugauaggcugacacagucccauccgauuuugaacaugaucgacaccaagaaaucaagccuaaauauaaguggguacaacuuuucucugggagcagccgugaaggcuggugccugcaugcucgauggcgggaacaugcuggaaacgaucaaagugagcccccaaacuauggacggcauucuuaagagcauccugaaagucaagaaagcauugggaauguucauuucggauaccccuggugagcggaauccauaugaaaacauccucuacaagauaugucugucuggggacggauggcccuauauugcuucccguacaucaaucacuggccgcgccugggagaauaccauuguugauuuagagagugacggcaagccucagaaagcggggaacaauggaagcaacaagucccugcagucugccgguuuuacagcaggccuaaccuacagccagcucaugacgcugaaagaugcuaugcuucaauuggacccaaaugccaagacuuggauggauaucgaagggagacccgaggacccuguggaaaucgcucuguaccagccaucaaguggaugcuauauucacuucuuuagggagccgacagaccucaaacaguucaagcaggaugccaaguacucccauggcauagacguaaccgaucuguuugcagcccaacccggucuuacuagcgcugugaucgacgcgcugccucggaacuuggucauuacaugucaggggucugaugacauccgaaaacuccuggaaucacagggccgcaaggauauaaaauuaauugacaucgcacugaguaagaccgauagcagaaaauaugagaaugccgugugggaccaguacaaggaucuaugccacaugcauacgggaaucguuguggagaagaaaaagaggggcgggaaagaagagauuaccccacacugugcucucauggacugcaucauguucgaugccgcagucuccggaggucugaacacaucugugcuucgggccguauugccccgcgacaugguuuuuagaacuucgaccccuagggugguccuguga

SEQ ID NO: 1753 - RNA, 1710 nt, Artificial Sequence
  derived and/or modified CDS sequence (opt3) from Lassa virus__AIT17289__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauucggaccucaaaagacugagggaucuuaaccaggccguaaauaaccugguggaguugaagucaacacaacagaaguccguccuccgggugggaacucugacgagugacgaucugcucguuuuagcggcugaccuggaaaaacuuaaguccaaagugacccgcacagagagacccuugucugccggugucuauaugggcaaucugagcucccagcagcuagaucaaaggcgggcacuccugucaaugauagggaugaguggaggcaaccagggugugcgcgccgggcgagacggaguaguuagaaucugggaugugaagaaugcugagcuucugaacaaucaguucggcacuaugccuagcuugacccucgcaugucugacaaaacagggccaagucgacuuaaacgauguggugcaggcccugaccgaccucgggcuuauuuacacugcuaaguauccaaauacaucugaccuggauagguugacccagucccauccgauccuaaacaugauugacacgaagaaaucaagccugaauaucaguggauacaacuuuucucucggugccgcggucaaggcaggcgccugcaugcuggaugggggaaauaugcuugaaacuauaaaaguuagcccccaaaccauggacggcauccugaaaagcauuuugaaggugaagaaagcucucgguauguucaucucggauacaccuggggagcggaacccauaugaaaacauucuguacaagaucuguuuaucuggagacggcuggcccuauauagccucccguacuucaauuaccggccgcgcaugggagaauacaaucguagaucuggagagugacgggaagccucagaaaaccggaagcauuaacuccaauaagucucuacagagcacggguuuugcugccggccucacuuacucacagcugaugacacuuaaagaugcgauguugcaacuggacccaaacgccaagaccuggauggauaucgaagggagacccgaggacccuguggaaaucgcacucuaccagccaaguuccggaugcuauauucacuucuuuagggagccgacugaccugaaacaguucaagcaggaugcuaaguacagccauggcauagacgucacagaucuuuuugccgcucaacccggucugaccucugccgugaucgacgcauugccucggaauaugguuauuacgugucaggggucagaugacauccgaaaacuccuggaaagucagggccgcaaggauauaaaauuaauugacaucgcccugagcaagaccgauuccagaaaauaugagaacgcugugugggaccaguacaaggaucuaugccacaugcauacaggaaucgucguggagaagaaaaagaggggcgggaaagaagagauuacuccacacugugcgcucauggacugcaucauguucgaugcagccguaucuggaggucugaauaccucgguucuucgggcuguguugccccgcgacauggucuuuagaacaagcacuccuagggugguccuguga

SEQ ID NO: 1754 - RNA, 1710 nt, Artificial Sequence
  derived and/or modified CDS sequence (opt3) from Lassa virus__AIT17293__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauaacgaccucaaaagacugagggaucuuaaucaagccguaaacaaucugguggaauugaagucgacacagcagaagucaguccuccgggugggaacucugacgagcgacgaucugcucguuuuagcggcugaccuggagaaacuuaagaguaaagugacccgcacagaaagacccuuguccgccggugucuauaugggcaaccugucuacucagcaacuagaucagaggcgggcacuccugaauaugauagggaugagcggaggcaaccagggugcccgcgcugggcgagacggagugguaagaguuugggaugugaagaaugcagaccuucugaacaaucaguucggcaccaugccuuccuugacacucgccugucugaccaaacaaggccaggucgauuuaaacgacguggugcaggcucugacugaccucgggcuuaucuacacagccaaguauccaaauaccucagaucuggacagguugacgcaaagucauccgauucuaaacaugaucgauacuaauaagagcucucugaacauuuccggauacaacuuuucacucggugcggcagucaaagccggcgcuugcaugcuggacgggggaaauaugcuugagaccaucaagguuagcccccagacaauggauggcauacugaaaaguaucuugaaggugaaaaaggcccucgguauguucauuucugacacuccuggggagcggaacccauaugaaaauauccuguacaaaauuuguuuauccggagauggcuggcccuauaucgcaagccguaccucgauaacaggccgcgcuugggagaacaccguaguggaccuggaaucugaugggaagccucagaaggccggagguaauaacuccaauaaaucacuacagagugcgggcuuuacggccgggcucacuuacagccaacugaugacacuuaaggacgcaauguugcagcuggauccaaacgcuaaaaccuggauggacauugagggaagacccgaggacccugucgaaaucgcccucuaccagccauccucuggcugcuauauucacuucuuuagggagccgacugaucugaagcaguucaaacaagacgcuaaguacagccaugguaucgaugugacagaccuuuuugccgcacagcccgggcugaccucagccguuaucgaugcuuugccucggaauauggugauuacgugucagggcagugacgauauacgaaagcuccuggaaucccagggacgcaaagacaucaaguuaauugauaucgcgcugagcaaaaccgacucuagaaaguaugagaacgcagucugggaucaauacaaagaccuaugcaauaugcacacaggcauagugguagaaaagaagaaaaggggagggaaggaggagauuacuccacauugugcccucauggauugcaucauguucgacgcugccguuucagguggcaugaacaccagugugcugcgggcaguccuuccccgcgacaugguguuuagaacaagcacuccuagggucguguuguga

SEQ ID NO: 1755 - RNA, 1710 nt, Artificial Sequence
  derived and/or modified CDS sequence (opt3) from Lassa virus__AIT17295__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuauccgcaccgagagacccuuguccgccgguguguauaugggcaaccugucuagccagcagcuagaucaaaggcgggcacuccugaauaugauugggaugggaggcuccaaccagggugcccgcgcugggcgagacggagucgugagaguaugggauguuaagaaugcagagcuucugaacaaucaguucggcacaaugccuucauugacucucgccugucugaccaaacagggccaaguggacuuaaacgaugcuguccaggcccugacagaccucgggcuuaucuacaccgcgaaguauccaaauacaagugaccuggauagguugacucagagccauccgauucuaaacaugaucgacaccaagaaaucuucccugaauauaucaggauacaacuuuagccucggugcagccgugaaggcuggcgccugcaugcuggaugggggaaacaugcuugaaacgaucaaagugaguccccaaacuauggacggcauucugaagucuaucuugaaagucaagaaagcacucgguauguucauuuccgauaccccuggggagcggaauccauaugaaaacauccuguacaagauauguuuaagcggagacggcuggcccuauauugcuucgcguacaucuaucacuggccgcgccugggagaauaccauuguugaucuggaguccgacgggaagccucagaaagcgggaucaaacgguaguaauaagagccuacaguccgccggcuuuacagcagggcucaccuacucucagcugaugacgcuuaaagaugcuauguugcaacuggacccaaacgccaagacuuggauggauaucgaaggaagacccgaggacccuguggaaaucgcucucuaccagccaagcucaggcugcuauauucacuucuuuagggagccgacagaccugaaacaguucaagcaggaugccaaguacagucaugguauagacguaaccgaucuuuuugcagcccaacccgggcugacuuccgcuaucauugacgcguugccucggaauauggugaucacaugucagggcagcgaugacauacgaaaacuccuggaaucucagggacgcaaggauauuaaauuaaucgacaucgcacugucaaagaccgauaguagaaaauaugagaacgccgucugggaccaguacaaggaucuaugccacaugcauacgggcauugugguugagaagaaaaagaggggagggaaagaagagaucaccccacacugugcucucauggacugcauuauguucgaugccgcagugagcgguggccugaauacauccguccuucgggccguguugccccgcgacaugguauuuagaacuucuaccccuaggguugugcuguga

SEQ ID NO: 1756 - RNA, 1710 nt, Artificial Sequence
  derived and/or modified CDS sequence (opt3) from Lassa virus__AIT17299__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucguuuuagcggcugaccuggaaaaacuuaagaguaaagugacccgcacagagagacccuuguccgccggugucuauaugggcaaccugucuagccagcagcuagaucaaaggcgggcacuccuguccaugauagggaugucaggaggcaaucagggugcccgcacugggcgagacggagugguaagaguuugggaugugaagaacgcugagcuucugaauaaccaguucggcaccaugccuaguuugacacucgcaugucugaccaaacagggccaagucgacuuaaaugauguggugcaggcccugacugaccucgggcuuaucuacacagcuaaguauccaaacaccagcgaccuggauagguugacgcagucucauccgauucuaaauaugaucgacacuaagaaauccucacugaacauuagcggauacaauuuuagucucggugccgcggucaaggcaggcgccugcaugcuggaugggggaaacaugcuugaaaccaucaaaguuucuccccaaacaauggacggcauacugaaguccaucuugaaagugaagaaagcucucgguauguucauuagcgauacuccuggggagcggaacccauaugaaaauauccuguacaagauuuguuuaucgggagacggcuggcccuauaucgccucucguaccuccauaacaggccgcgcaugggagaacaccguaguggaucuggagucagacgggaagccucagaaagcuggaaguaauaacagcaauaagucccuacagucugccgguuuuacggcgggccucacuuacagccagcugaugacacuuaaagaugccauguugcaacuggacccaaacgcaaagaccuggauggauauugaagggagacccgaggacccugucgaaaucgcucucuaccagccaucaaguggaugcuauauucacuucuuuagggagccguccgaccugaaacaguucaagcaggaugccaaguacagccauggcaucgacgugacugaucuuuuugcugcccaacccggucugacaucugcaguuaucgacgccuugccucggaauauggugauuaccugucaggggucagaugacauacgaaaacucuucgaaagucagggccgcaaggauaucaaacugauugacaucgcuuuaagcaagacggauuccagaaaauaugagaacgcggucugggaccaguacaaggaucugugccacaugcauaccggagugguaguugagaagaaaaagaggggcgggaaagaagagauaacaccacacugugcacuaauggacugcauuauguuugaugccgcugugucuggaggucucaauucgcugguccuucgggccguguugccccgcgacauggucuucagaacuagcaccccuagggugguucuguga

SEQ ID NO: 1757 - RNA, 1710 nt, Artificial Sequence
  derived and/or modified CDS sequence (opt3) from Lassa virus__AIT17303__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauucggaccucaaaagacugagggaucuuaaccaagccguaaauaaccugguggaauugaagucaacacagcagaaguccguccuccgggugggaacucugacgagugacgaucugcucguuuuagcggcugaccuggagaaacuuaaguccaaagugauacgcaccgaaagacccuugucuagcggugucuauaugggcaaucuguccucacagcaacuagaucagaggcgggcccuccugaacaugaucgggaugaguggaggcaaucagggugcacagguggggcgcgacggaguaguucgagugugggaugucaagaacgccgaccuucugaauaaccaauucggcacaaugccuagcuugacucucgcuugucugaccaaacagggccagguggauuuaaaugacgugguccaagcacugacagaccucgggcuuauuuacaccgccaaguauccaaacacuucugaucuggacagauugguucagucccauccgauccuaaauaugauugauacaaagaaaucaagccugaacaucaguggauacaauuuuucucucggugcugccgugaaggcgggcgcaugcaugcuggacgggggaaacaugcuugagaccauaaaaguaagcccccagacgauggauggcauccugaaaagcauuuugaaggugaagaaagcccucgguauguucaucucggagacuccuggggaaaggaacccauaugagaauauucuguacaagaucuguuuaucuggagacggcuggcccuauauagcuucccggaccucaauuacaggccgugccugggaaaacacuaucgucgaucuggagagugacgggaagccucagaaagcaggaagcaauaacuccaauaagucucuacaaagcgcugguuuuaccgccggccucacauacucacagcugaugacccuuaaagauaguauguugcagcuggacccaaacgcgaagacguggauggauauugaggggcgccccgaagacccuguggagguugcccucuaccagccauccagcggaugcuauauccacuucuuuagagaaccgacugaccugaaacaauucaagcaggaugcaaaguacucucauggcaucgacgugacagaucuuuuugcugcccagcccggucugaccucagcugucauugaggccuugccuaggaauauggugauaacuugucaggggagugacgauauccggaaacuccuggaaagccaaggccgaaaggacauuaaauuaaucgauauagcacugaacaagacagacucccgcaaauaugagaaugccguaugggaucaguacaaggaccuaugccacaugcauaccggaguuguggucgagaagaaaaagagaggcgggaaagaagagauuacgccacacugugcucucauggauugcaucauguucgacgcggcagugucuggaggucugaagacccuugucuugagggccgugcugccccgggauaugguuuuucgcacaucgacuccuaaagugguacucuga

SEQ ID NO: 1758 - RNA, 1710 nt, Artificial Sequence
  derived and/or modified CDS sequence (opt3) from Lassa virus__AIT17307__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuacccgcacagagagacccuuguccgccgguguguauaugggcaaccugucuagccagcagcuagaucaaaggcgggcacuccuguccaugaucgggaugucaggaggcaaucagggugcccgcacugggcgagacggagucgugagaguaugggauguuaagaacgcugagcuucugaauaaccaguucggcaccaugccuaguuugacacucgcaugucugaccaaacagggccaaguggacuuaaaugaugucgugcaggcccugacugaccucgggcuuauuuacacagcuaaguauccaaacaccagcgaccuggauagguugacgcagucucauccgauccuaaauaugauugacacuaagaaauccucacugaacaucagcggauacaauuuuagucucggugccgcggugaaggcaggcgccugcaugcuggaugggggaaacaugcuugaaaccauaaaagucucuccccaaacaauggacggcauccugaaguccauuuugaaaguuaagaaagcucucgguauguucaucagcgauacuccuggggagcggaacccauaugaaaauauucuguacaagaucuguuuaucgggagacggcuggcccuauauagccucucguaccuccauuacaggccgcgcaugggagaacaccgugguagaucuggagucagacgggaagcuacagaaaacgggaaguaauaacagcaauaagucccuccagucugcugguuuuacugccggccugacauacagccagcuuaugaccuugaaagaugcgaugcugcaacucgacccuaacgccaagaucuggauggauauugaagggagaccagaggaccccguggaaaucgcacuguaccagccuucaaguggaugcuauauccacuucuuuagggagccaacugaccuuaaacaguucaagcaggaugcuaaguacucccauggcauugacgucacagaucuguuugccgcucaaccggguuugaccagcgccgugauagacgcacucccccggaauaugguuaucacgugucaggggucugaugacauucgaaaacuguuagaaucacagggccgcaaggauaucaaacugauagacauugcccuaaacaagaccgauaguagaaaauaugagaaugcugugugggaccaguacaaggaucucugccacaugcauacaggagucgugguagagaagaaaaagaaaggcgggaaggaagagaucacuccucacugugcgcugauggacugcaucauguucgaugcagccguuagcggaggucuuaacaccuccguguugagggcuguccugccacgggacaugguguuucgcacaucuacucccagagucgugcucuga

SEQ ID NO: 1759 - RNA, 1710 nt, Artificial Sequence
  derived and/or modified CDS sequence (opt3) from Lassa virus__AIT17311__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuauccgcaccgagagacccuuguccgccgguguguauaugggcaaccugucuagccagcagcuagaucaaaggcgggcacuccugaauaugauugggaugggaggcuccaaccagggugcccgcgcugggcgagacggagucgugagaguaugggauguuaagaaugcagagcuucugaacaaucaguucggcacaaugccuucauugacucucgccugucugaccaaacagggccaaguggacuuaaacgaugcuguccaggcccugacagaccucgggcuuaucuacaccgcgaaguauccaaauacaagugaccuggauagguugacucagagccauccgauucuaaacaugaucgacaccaagaaaucuucccugaauauaucaggauacaacuuuagccucggugcagccgugaaggcuggcgccugcaugcuggaugggggaaacaugcuugaaacgaucaaagugaguccccaaacuauggacggcauucugaagucuaucuugaaagucaagaaagcacucgguauguucauuuccgauaccccuggggagcggaauccauaugaaaacauccuguacaagauauguuuaagcggagacggcuggcccuauauugcuucgcguacaucuaucacuggccgcgccugggagaauaccguuguggaucuggaguccgacgggaagccucagaaagcgggaucaaacgguaguaauaagagccuacaguccgccggcuuuacagcagggcucaccuacucucagcugaugacgcuuaaagaugcuauguugcaacuggacccaaacgccaagacuuggauggauauugaaggaagacccgaggacccuguagaaguggcucucuaccagccaagcucaggcugcuauauccacuucuuuagggagccgacagaccugaaacaguucaagcaggaugccaaguacagucaugguaucgacgucaccgaucuuuuugcagcccaacccgggcugacuuccgcugugauugacgcguugccucggaauaugguuauaacaugucagggcagcgaugacauccgaaaacuccuggaaucucagggacgcaaggauauuaaauuaaucgacauagcacugucaaagaccgauaguagaaaauaugagaacgccgugugggaccaguacaaggaucuaugccacaugcauacgggcauugucguggagaagaaaaagaggggagggaaagaagagaucaccccacacugugcucucauggacugcaucauguucgaugccgcaguaagcgguggccugaauacauccguucuucgggccguguugccccgcgacauggucuuuagaacuucuaccccuagggugguccuguga

SEQ ID NO: 1760 - RNA, 1710 nt, Artificial Sequence
  derived and/or modified CDS sequence (opt3) from Lassa virus__AIT17315__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuacccgcacagagagacccuuguccgccgguguguauaugggcaaccugucuagccagcagcuagaucaaaggcgggcacuccugaauaugaucgggauguccggaucaaaccagggcgcccgcgcuggucgagacggggucgugagaguaugggauguuaagaauguggagcuucugaacaaucaguucggaacuaugccuaguuugacccucgcaugucugacaaaacagggccaagucgacuuaaacgaugccgugcaggcucugaccgaccucggccuuauuuacacugccaaguauccaaauacaagcgaccuggauagguugacccagucucauccgauccuaaacaugauugacacgaagaaauccucacugaauaucagcggguacaacuuuagucucggagcggcagugaaggccggugcuugcaugcuggauggcgggaacaugcuugaaacuauaaaagucucuccccaaaccauggacggaauccugaaguccauuuugaaaguuaagaaagcccucggcauguucaucagcgauacaccuggugagcggaauccauaugaaaacauucuguacaagaucuguuuaucgggggacggauggcccuauauagcaucucguacuuccauuaccggccgcgcuugggagaauacagugguagaucuggagucagacggcaagccucagaaagccgggaguaacagcuccaauaagucucuacagagcgcgggauuuaccgccggucucacguacucacagcugaugacucuuaaagaugcaauguugcaacuggacccaaacgcuaagacauggauggauaucgaaggcagacccgaggacccuguggaaauugcccucuaccagccaaguuccgggugcuauauccacuucuuuagggagccgaccgaccugaaacaguucaagcaggaugcuaaguacagccauggaaucgacgucacugaucuuuuugccgcacaacccggccugacaucugccgugauugacgcuuugccucggaauaugguuauaaccugucaggguucagaugacauccgaaaacuccuggaaagucaggggcgcaaggauauuaaauuaaucgacauagcgcugagcaagacggauuccagaaaauaugagaacgcagugugggaccaguacaaggaucuaugccacaugcauaccggcauugucguggagaagaaaaagaaaggaucuaaggaagagaucacaccacacugugcccucauggacugcaucauguucgaugcugccguaucgggcgggcugaaugcaagcguucuuagggccguguugccccgggacauggucuuucgcacuuccaccccuagagugguccuguga

SEQ ID NO: 1761 - RNA, 1710 nt, Artificial Sequence
  derived and/or modified CDS sequence (opt3) from Lassa virus__AIT17319__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauucggaccucaaaagacugagggaucuuaaccaagccguaaauaaccugguggaauugaagucaacacagcagaaaagcguccuccgggugggaacucugacgagugacgaucugcucguuuuagcggcugaccuggagaaacuuaaguccaaagugauacgcaccgaaagacccuugucuagcggugucuauaugggcaaucuguccucacagcaacuagaucagaggcgggcccuccugaacaugaucgggaugaguggaggcaaucagggugcacagguggggcgcgacggaguaguucgagugugggaugucaagaacgccgacaugcuuaauaaccaauucggcacaaugccuagccugacuuuggcuugucucaccaaacagggccagguggaucugaaugacgugguccaagcauuaacagaccuggggcucauuuacaccgccaaguauccaaacacuucugaucuugacagacuggcucagucccauccgaucuugaauaugauugauacaaagaaaucaagccuaaacaucaguggauacaauuuuucucugggugccgcgguuaaggcaggcgccugcaugcucgacgggggaaacaugcuggagaccauaaaagugagcccccagacgauggauggcauccuuaaguccauucugaaaguaaagaaggcuuuggguauguucaucucggagacuccuggggaaaggaacccauaugagaauauucucuacaagaucugucugucuggagacggcuggcccuauauagccucccggaccucaauuacaggccgugcaugggaaaacacuaucguggauuuagagagugacgggaagccucagaaagcuggaagcaauaacuccaauaagucucugcaaagcgccgguuuuaccgcgggccuaacauacucacagcucaugacccugaaagauaguaugcuucaguuggacccaaacgccaagacguggauggauauugaggggcgccccgaagacccugucgagguggcacuguaccagccauccagcggaugcuauauccacuucuuuagagaaccgacugaccucaaacaauucaagcaggaugcuaaguacucucauggcaucgacguuacagaucuguuugccgcucagcccggucuuaccucagccgugauugaggcacugccuaggaauauggucauaacuugucaggggagugacgauauccggaaauugcucgaaagccaaggccgaaaggacauuaaacugaucgauauaguguuaaacaagacagacucccgcaaauaugagaaugccguaugggaucaguacaaggaccugugccacaugcauaccggaguuguggucgagaagaaaaagagaggcgggaaagaagagauuacgccacacugugcucuaauggauugcaucauguucgacgcggcagugucuggaggucucaagaccaugguccugagggccgugcuuccccgggauaugguuuuucgcacaucgacuccuaaagugguauuguga

SEQ ID NO: 1762 - RNA, 1710 nt, Artificial Sequence
  derived and/or modified CDS sequence (opt3) from Lassa virus__AIT17323__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauucggaccucaaaagacugagggaucuuaaccaagccguaaauaaccugguggaauugaagucaacacagcagaaguccguccuccgggugggaacucugacgagugacgaucugcucguuuuagcggcugaccuggagaaacuuaaguccaaagugauacgcaccgaaagacccuugucuagcggugucuauaugggcaaucuguccucacagcaacuagaucagaggcgggcccuccugaacaugaucgggaugaguggaggcaaucagggugcacagguggggcgcgacggaguaguucgagugugggaugucaagaacgccgaccuucugaauaaccaauucggcacaaugccuagcuugacucucgcuugucugaccaaacagggccagguggauuuaaaugacgugguccaagcacugacagaccucgggcuuauuuacaccgccaaguauccaaacacuucugaucuggacagauuggcucagucccauccgauccuaaauaugauugauacaaagaaaucaagccugaacaucaguggauacaauuuuucucucggugccgcgguuaaggcaggcgccugcaugcuggacgggggaaacaugcuugagaccauaaaagugagcccccagacgauggauggcauccugaaaagcauuuugaagguaaagaaagcucucgguauguucaucucggagacuccuggggaaaggaacccauaugagaauauucuguacaagaucuguuuaucuggagacggcuggcccuauauagccucccggaccucaauuacaggccgugcaugggaaaacacuaucguggaucuggagagugacgggaagccucagaaagcuggaagcaauaacuccaauaagucucuacaaagcgccgguuuuaccgcgggccucacauacucacagcugaugacccuuaaagauaguauguugcagcuggacccaaacgccaagacguggauggauauugaggggcgccccgaagacccugucgagguggcacucuaccagccauccagcggaugcuauauccacuucuuuagagaaccgacugaccugaaacaauucaagcaggaugcuaaguacucucauggcaucgacguuacagaucuuuuugccgcucagcccggucugaccucagccgugauugaggcauugccuaggaauauggucauaacuugucaggggagugacgauauccggaaacuccuggaaagccaaggccgaaaggacauuaaauuaaucgauauagcccugaacaagacagacucccgcaaauaugagaaugcugugugggaucaguacaaggaccuaugccacaugcauaccggaguaguuguggagaagaaaaagagaggcgggaaagaagagauuacgccacacugugcgcucauggauugcaucauguucgacgcagccgucucuggaggucugaagacccuuguguugagggcuguccugccccgggauaugguguuucgcacaucgacuccuaaaguugugcucuga

SEQ ID NO: 1763 - RNA, 1710 nt, Artificial Sequence
  derived and/or modified CDS sequence (opt3) from Lassa virus__AIT17325__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauaacgaccucaaaagacugagggaucuuaaucaagccguaaacaaucugguggaauugaagucgacacagcagaagucaguccuccgggugggaacucugacgagcgacgaucugcucguuuuagcggcugaccuggagaaacuuaagaguaaagugacccgcacagaaagacccuuguccgccggugucuauaugggcaaccugucuagccagcaacuagaucagaggcgggcacuccugaauaugauagggaugacuggaggcucccgcggugcccaggcugggggagacggcgugguacgaguuugggaugugaagaacgcagaccuucugaauaaccaguucggcaccaugccuucauugacacucgccugucugaccaaacaagggcaggucgauuuaaaugacguggugcaggcucugacugaccucggacuuaucuacacagccaaguauccaaacaccagugaucuggacagauugacgcaaagccauccgauucuaaauaugaucgauacuaagaaaucuucccugaacauuucagguuacaauuuuagccucggcgcggcagucaaggccggggcuugcaugcuggacggaggcaacaugcuugagaccaucaaaguuaguccccagacaauggaugguauacugaagucuaucuugaaagugaagaaaucccucgggauguucauuagcgacacuccuggagagaggaacccauaugaaaauauccuguacaagauuuguuuaucgggcgauggcuggcccuauaucgccucucggaccuccauaacagggcgugcaugggagaacaccguaguggaccuggaaucagauggaaagccucagaaagcugguggcaauaacaguaauaagagccuacaguccgccggguuuacggcgggacucacuuacucucaacugaugacacuuaaagacaccauguugcagcuggauccaaacgccaagacuuggauggacauugagggccgccccgaggacccugucgaaguggcacucuaccagccaagcucagguugcuauauccacuucuuuagagagccgacagaucugaaacaguucaagcaagacgcuaaguacagucaugggauugauguuaccgaccuuuuugccgcucagcccggccugacguccgccgugaucgaagcauugccuaggaauauggucaucaccugucagggaagcgaugacauucggaaacuccuggagucucagggccgaaaggauauaaaauuaaucgacauugcccugucaaagguggauagucgcaaauaugaaaacgcuguaugggaccaauacaaggaucuaugccacaugcauacagggguuguggucgagaagaaaaagagaggagguaaagaggaaaucacuccacacugugcgcucauggacugcauaauguucgaugcagccgugagcggcgggcugaauacccuugucuugagggcugugcugccccgggacaugguuuuucgcacauccacuccuaaggugguacucuga

SEQ ID NO: 1764 - RNA, 1710 nt, Artificial Sequence
  derived and/or modified CDS sequence (opt3) from Lassa virus__AIT17329__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauucggaccucaaaagacugagggaucuuaaccagacaguaaauaaccugguggaguugaagucaacucaacagaagaguauacuccgggucggaacgcugaccagugacgaucugcucaucuuagccgcggaccuggaaaaacuuaaguccaaagugauucgcacagagagacccuugucugcugguguuuauaugggcaaucugagcucccagcagcuagaucaaaggcgggcccuccugaacaugaucgggaugucaaguggaaaucagggcgcacaggccggucgcgacggggugguccgagugugggauguaaagaacgcugagcuucugaauaaccaguucggaacuaugccuagcuugacccucgcaugucugacaaaacaaggccagguugacuuaaaugaugccgugcaggcucugaccgaccucggccuuauuuacacugccaaguauccaaacacaucugaccuggauagauugacccaaucccauccgauccuaaauaugauagacacgaagaaaucaagccugaacaucaguggguacaauuuuucucucggagcggcagucaaggccggugcuugcaugcuggauggcgggaacaugcuugaaacuauuaaagugagcccccagaccauggacggaauccugaaguccauuuugaaagugaagaaagcccucggcauguucaucucggauacaccuggugagaggaacccauaugaaaauauacuguacaagauuuguuuaucuggggacggauggcccuauaucgcaucccggacuucaauuaccggccgugcuugggagaacacagucguugaucuggagagugacggcaugccucagaaggccgggagcuccucuagcaauaaaucacuacagagugcgggauuuguggccggucucaccuacucccaacugaugacgcuuaaggaugcaauguugcagcuggacccaaacgcuaaaacuuggauggauaucgaaggccgccccgaggacccuguagaaaucgcccucuaccagccaagcucugggugcuauauucacuucuuuagagagccgacagaccugaagcaguucaaacaagaugcuaaguacucacauggaauagacgugaccgaucuuuuugccgcacagcccggccugacuagcgccgucaucgacgcuuugccuaggaauauggugauuacaugucaggguagcgaugacauccggaagcuccuggaaucccaggggcgaaaagauauaaaguuaauugacaucgcgcugucuaaagcagauucgcgcaaguaugagaacgccguuugggaccaauacaaagaucuaugccacaugcauaccggcguggucguggagaagaagaaaagaggaggcaaggaagagaucacgccacacugugcucucauggacugcauuauguaugaugccgcaguaagcgggggacugaauaccuccguucuuagggccguguugccccgggacauggucuuccgcacaucaacuccuagagugguccuguga

SEQ ID NO: 1765 - RNA, 1710 nt, Artificial Sequence
  derived and/or modified CDS sequence (opt3) from Lassa virus__AIT17333__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaguccuccgggugggaacucugacgagcgacgaucugcucauauuagcggcugaccuggaaaaacuuaagaguaaaguuacccgcacagagagacccuuguccgccgguguguauaugggcaaccugucuagccagcagcuagaucaaaggcgggcacuccugaauaugaucgggauguccggaggcaaccagggugcccgcgcugggcgagacggagucgugagaguaugggauguuaagaaugcagagcuucugaacaaucaguucggcacuaugccuucauugacccucgccugucugacaaaacagggccaaguggacuuaaacgaugcuguccaggcccugaccgaccucgggcuuauuuacacugcgaaguauccaaauacaagugaccuggauagguugacccagagccauccgauccuaaacaugauugacacgaagaaaucuucccugaauaucucaggauacaacuuuagccucggugcagccgugaaggcuggcgccugcaugcuggaugggggaaacaugcuugaaacuauaaaagugaguccccaaaccauggacucuauccugaaguccauuuugaaagucaagaaagcacucggcauguucaucagcgauacaccuggugagcggaauccauaugaaaacauucuguacaagaucuguuuaucgggggacggauggcccuauauagcuucucguacuuccauuaccggccgcgccugggagaauacaguuguggaucuggagucagacggcaagccucagaaagcggggaguaacaauagcaacaagucccuacagucugccggauuugcagcuggucucaccuacagccagcugaugacgcuuaaagaugccauguugcaacuggacccaaaugcuaagacuuggauggauaucgaaggcagacccgaggacccuguagaaauugcccucuaccagccaucaagugggugcuauauccacuucuuuagggagccgacagaccugaaacaguucaagcaggaugcaaaguacucccauggaaucgacgugaccgaucuuuuugccgcucaacccggccugacuagcgcggucauugacgcauugccucggaacauggugauaacaugucaggguucugaugacauccgaaaacuccuggaaucacaggggcgcaaggauauuaaauuaaucgacauagcccugaguaagaccgauagcagaaaauaugagaaugcuguuugggaccaguacaaggaucuaugccacaugcauacgggcauuguggucgagaagaaaaagaggggaggcaaagaagagaucaccccacacugugcccucauggacugcaucauguucgaugcagccguguccgggggacugaacacaucuguacuucgggcuguuuugccccgcgacaugguguuuagaacuucgaccccuagggucgugcuguga

SEQ ID NO: 1766 - RNA, 1710 nt, Artificial Sequence
  derived and/or modified CDS sequence (opt3) from Lassa virus__AIT17335__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauucggaccucaaaagacugagggaucuuaaccaggccguaaauaaccugguggaguugaagucaacacaacagaaaagcauacuccgggucggaacucugacgagugacgaucugcucaucuuagcggcugaccuggaaaaacuuaaguccaaagugacccgcacagagagacccuugucugccgguguuuauaugggcaaucugagcucccagcagcuagaucaaaggcgggcacuccugucaaugauugggaugaguagcggagugcagggcgcccgcgcuggucgagacggggucgugagaguaugggauguuaagaacgcagagcuucugaauaaccaguucggaacuaugccuucuuugacccucgccugucugacaaaacagggccaaguggacuuaaaugaugucgugcaggcucugaccgaccucggccuuaucuacacugccaaguauccaaacacauccgaccuggauagguugacccagucacauccgauucuaaauaugaucgacacgaagaaaagcagucugaacauaucuggguacaauuuuucccucggagcggcagugaaggccggugcuugcaugcuggauggcgggaacaugcuugaaacuaucaaagucagcccccaaaccauggacggcauucugaagucgaucuugaaaguuaagaaagcccucggaauguucauuucugagacaccuggugaacggaauccauaugagaacauccuguacaagauauguuuauccggggauggauggcccuauauugcaucacguacuucgaucaccggccgcgcuugggagaacacagugguagaccuggaaagcgauggcaagccucagaaagccggguccaauaacucuaauaagagccuacagucaaccggauuugcggccggucucacguacagucagcugaugacucuuaaagacgcaauguugcaacuggauccaaacgcuaagacauggauggacauugagggcagacccgaagauccuguggaggucgcccucuaccagccauccagcgggugcuauauccacuucuuuagggaaccgaccgaccugaaacaguucaagcaggacgcuaaguacucucauggaaucgaugugacugaccuuuuugccgcacaacccggccugacaucagccguuauugaugcuuugccucggaauauggugauaaccugucaggguagugacgauaucaaaaagcuccuggagagccaggggcgaaaagacauuaaguuaaucgauauagcgcuguccaaaacggacucucgcaaguaugagaacgcagucugggaucaguacaaggaccuaugccacaugcauaccggcgugguaguugaaaagaagaaaagaggaggcaaggaggaaauuacaccacacugugcccucauggauugcaucauguucgacgcugccgugagugggggacugaauacuagcguccuuagggcaguguugccccgggauauggucuuucgcaccuccacaccuagagugguucuguga

SEQ ID NO: 1767 - RNA, 1710 nt, Artificial Sequence
  derived and/or modified CDS sequence (opt3) from Lassa virus__AIT17341__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaggcaaccagggugcccgcgcugggcgagacggaguggucagagugugggauguaaagaaugcagagcuucugaacaaucaguucggcacuaugccuucauugacccucgccugucugacaaaacagggccaaguugacuuaaacgaugcugugcaggcccugaccgaccucgggcuuaucuacacugcgaaguauccaaauacaagugaccuggauagguugacccagagccauccgauucuaaacaugaucgacacgaagaaaucuucccugaauauaucaggauacaacuuuagccucggugcagccgucaaggcuggcgccugcaugcuggaugggggaaacaugcuugaaacuaucaaagugaguccccaaaccauggacggcauucugaagucuaucuugaaagugaagaaagcacucgguauguucauuuccgaugcuccuggggagcggaauccauaugaaaacauccuguacaagauauguuuaagcggagacggcuggcccuauauugccucgcguacaucuaucacuggccgcgcgugggagaauaccgucguugaucuggaguccgacgggaagccucagaaagccggaucaaacgguaguaauaagagccuacaguccgcaggcuuuacagcugggcucaccuacucucagcugaugacgcuuaaagaugccauguugcaacuggacccaaacgcuaagacuuggauggauauugaaggaagacccgaggacccuguggaaaucgcccucuaccagccaagcucaggcugcuauauccacuucuuuagggagccgacagaccugaaacaguucaagcaggaugcaaaguacagucaugguauugacguaaccgaucuuuuugccgcucaacccgggcugacuuccgcggugauagacgcauugccucggaauauggucaucacaugucagggcagcgaugacauucgaaaacucuucgaaucucagggacgcaaggauaucaaacugauagacauugccuuaucaaaggcugauaguagaaaauaugagaacgccgugugggaccaguacaaggaucugugccacaugcauaccggcguuguggucgagaagaaaaagaggggagggaaagaagagaucacgccacacugugcacuaauggacugcaucauguuugaugccgcugugagcgguggccucaauaccuccguacugcgggccguucuuccccgcgacaugguguucagaacaucuacuccuagggucguguuguga

SEQ ID NO: 1768 - RNA, 1710 nt, Artificial Sequence
  derived and/or modified CDS sequence (opt3) from Lassa virus__AIT17345__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccuguccaugauugggaugucaaguggagugcagggcgcccgcgcuggucgagacggggucgugagaguaugggauguuaagaaugcagagcuucugaacaaucaguucggaacuaugccuagcuugacccucgccugucugacaaaacagggccaaguggacuuaaacgaugucgugcaggcucugaccgaccucggccuuaucuacacugccaaguauccaaauacaucugaccuggauagguugacccagucccauccgauucuaaacaugaucgacacgaagaaaucaagccugaauauaaguggguacaacuuuucucucggagcggcagugaaggccggugcuugcaugcuggauggcgggaauaugcuugaaacuaucaaagucagcccccaaaccauggacggaauuuugaaguccauccugaaaguuaagaaagcccucggcauguucauuucggagacaccuggugaacggaacccauaugagaacauccuguacaagauauguuuaucuggggauggauggcccuauauugcaucccguacuucaaucaccggccgcgcuugggagaauacagugguagaccuggaaagugauggcaagccucagaaagccgggagcaacaauuccaacaagucucuacagagcgcgggauuuaccgccggucucacguacucacagcugaugacucuuaaagacgcaauguugcaacuggauccaaaugcuaagacauggauggacauugagggcagacccgaagauccuguggaggucgcccucuaccagccaaguuccgggugcuauauccacuucuuuagggaaccgaccgaccugaaacaguucaagcaggacgcuaaguacagccauggaaucgaugugacugaccuuuuugccgcacaacccggccugacaucugccguuauugaugcuuugccucggaacauggugauaaccugucaggguucagacgauaucaaaaagcuccuggagagucaggggcgaaaagacauuaaguuaaucgauauagcgcugagcaaaacggacucccgcaaguaugagaaugcagucugggaucaguacaaggaccuaugccacaugcauaccggcgugguaguugagaaaaagaaaagaggaggcaaggaagaaauuacaccacacugugcccucauggauugcaucauguucgacgcugccgugucugggggacugaacacuucgguccuuagggcaguguugccccgggauauggucuuucgcaccagcacaccuagagugguucuguga

SEQ ID NO: 1769 - RNA, 1710 nt, Artificial Sequence
  derived and/or modified CDS sequence (opt3) from Lassa virus__AIT17351__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauggagaccucaaaagacugagggaucuuaaccaagccguaaauaaccugguggaauugaagucgacacagcagaagucaguccuccggguggguacucugacgagcgacgaucugcucauauuagcggcugaccuggagaaacuuaagaguaaaguuauccgcaccgaaagacccuuguccgccggcguguauauggggaaucugucuagccagcaacuagagcagaggcgggcacuccugaacaugauuggaauguccucaggcaaucagggugcccgcacagggaaggauggagucgugcgaaucugggacguaaagaacgcugaucuucugaauaaccaguucggcacuaugccuaguuugacccucgcaugucugacaaagcaaggccagguugacuuaaaugaugugguccaggcccugaccgaccucgggcuuauuuacacugcuaaguauccaaacacaagcgaccuggauagauugacccaaucucauccgauccuaaauaugguggacacguccaaaucaagccugaacauaaguggauacaauuuuucucucggugccgcggugaaggcaggcgccugcaugcuggaugggggaaacaugcuugagacuaucaaagucaguccccagaccauggacggcauucugaaaagcaucuugaaaguuaagaaaucgcucgguauguucgugucugauacaccuggggaaaggaacccauaugagaauauucuguacaagaucuguuuauccggagacggcuggcccuauauagcuucacggacuuccauuaccggccgugccugggaaaacacaguaguggaucuggagagcaaugggaagccucagaaagcaggauccaacaauucuaacaagagccuacagucaaccgguuuuacggcuggccucacuuacagucaacugaugacacuuaaagacgccauguugcagcuggauccaaaugcgaagaccuggauggacaucgaggggcgccccgaagauccugucgagauugcccucuaccagccauccagcggaugcuauauccacuucuuuagagaaccgacugaccugaaacaguucaagcaagacgcaaaguacucucauggcaucgaugugacagaccuuuuugcugcccagcccggucugaccucagcuguuauugauacguugccuaggaacauggugauaaccugucaggggagugacgauauccggaaacuccuggagagccagggccgaaaggacauuaaauuaaucgauauagcccuguccaagauugacucucgcaaauaugaaaaugcagucugggaucaauacaaggaccuaugccacaugcauacaggagugguaguugagaagaaaaagagaggcgggaaagaggaaaucacuccacacugugcccucauggauugcaucauguucgacgcugcggugucgggaggucugaacgcaagcguccuuagggccguguugccccgggauauggucuuucgcaccuccacaccuagagugguucuguga

SEQ ID NO: 1770 - RNA, 1710 nt, Artificial Sequence
  derived and/or modified CDS sequence (opt3) from Lassa virus__AIT17359__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauucggaccucaaaagacugagggaucuuaaccaggccguaaauaaccugguggaguugaagucaacacaacagaaguccauacuccgggucggaacucugacgagugacgaucugcucaucuuagcggcugaccuggaaaaacuuaaguccaaagugacccgcacagagagacccuugucugccgguguuuauaugggcaaucugagcucccagcagcuagaucaaaggcgggcacuccugaacaugcuugggaugucaggaaguaaucagggcgcccgcgcuggucgagacgggguggucagagugugggauguaaagaacgcagagcuguugaauaaccaguucggaacuaugccuagccucacccuggccuguuuaacaaaacagggccaaguugaccugaaugaugcugugcaggcccucaccgaccuuggccugauuuacacugcgaaguauccaaacacaucugacuuggauaggcuaacccagucccauccgauccugaauaugauugacacgaagaaaucaagccucaacaucaguggguacaauuuuucucugggagcagccgucaaggcuggugccugcaugcuugauggcgggaacaugcuggaaacuauaaaagugagcccccaaaccauggacggaauccucaagagcauuuugaaagugaagaaagcacugggcauguucaucucggauacaccuggugagcggaacccauaugaaaauauuuuauacaagaucugucugucuggggacggauggcccuauauagcuucccguacuucaauuaccggccgcgccugggagaacacagucguugaucuagagagugacgaaaagccucagaaagcgggcagcaauuccucuaacaagagccuccagucagccggguuuaccgcaggacugacguacagucagcuuaugacuuugaaagaugcuaugcugcaacucgacccaaaugccaagacauggauggauaucgaggguagacccgaagacccuguggagauugcucuguaccagccauccagcggcugcuauauccacuucuuuagggaaccgaccgaccuuaaacaguucaagcaggaugccaaguacucucaugggaucgacguaacugaucuguuugcagcccaacccggauugacaucagcugugauugacgcgcucccucggaacauggucauaaccugucagggcagugaugacauccgaaaacuguuagagagccagggucgcaaggauauuaaacugaucgacauagcacuauccaagacggauucuagaaaauaugagaaugccgugugggaccaguacaaggaucucugccacaugcauaccgggauuguuguggaaaagaaaaagaggggcggaaaagaggaaaucacaccacacugugcucugauggacugcaucauguucgaugccgcagucucgggcgggcuuaacgccagcguguugcgggcuguacugccccgcgacaugguuuuuagaacuuccaccccuagggugguccucuga

SEQ ID NO: 1771 - RNA, 1710 nt, Artificial Sequence
  derived and/or modified CDS sequence (opt3) from Lassa virus__AIT17361__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauucggaccucaaaagacugagggaucuuaaccaggccguaaauaaccugguggaguugaagucaacacaacaaaagagcguccuccgggugggaacucugacgagugacgaucugcucguuuuagcggcugaccuggaaaaacuuaaguccaaagugacccgcacagagagacccuugucugccggugucuauaugggcaaucugagcucccagcagcuagaucagaggcgggcacuccugaacaugauagggaugucaggaggcaaucagggugcccgcgcugggcgagacggagugguaagaaucugggauguuaagaacgcagagcuucugaauaaccaguucggcacuaugccuaguuugacccucgccugucugacaaaacagggccaaguggacuuaaaugaugucgugcaggcucugaccgaccucgggcuuauuuacacugccaaguauccaaacacaagcgaccuggauagguugacccagucucauccgauccuaaauaugauugacacgaagaaauccucacugaacaucagcggauacaauuuuagucucggugcggcagugaaggccggcgcuugcaugcuggaugggggaaacaugcuugaaacuauaaaagucucuccccaaaccauggacggcauccugaaguccauuuugaaaguuaagaaagcccucgguauguucaucagcgauacaccuggggagcggaacccauaugaaaauauucuguacaagaucuguuuaucgggagacggcuggcccuauauagcaucucguacuuccauuaccggccgcgcuugggagaacacaaucguggaucuggagucagacgggaagccucagaaaaccaauaacacgaauaguaacaagagccuacaguccgccggauuugcggccggucucacuuacucucagcugaugacacuuaaagaugcaauguugcaacuggacccaaaugcuaagaccuggauggauauugaaggcagacccgaggacccuguagaaaucgcccucuaccagccaagcucagggugcuauauccacuucuuuagggagccgacugaccugaaacaguucaagcaggaugcuaaguacagucauggaauugacgugacagaucuuuuugccgcacaacccggccugaccuccgccgucauagacacguugccucggaacauggugaucaccugucaggguagcgaagauauucgacgccuccuggagucucaggggagaaaagacaucaaguuaauagauauugcucugucaaaaacagacaguaggaaguaugagaaugcgguuugggaucaguacaaagaccuaugccacaugcauacuggcguggucguggaaaagaagaaaaagggaggcaaagaggaaaucaccccacacugugcacucauggauugcaucauguucgacgccgcuguaagcgggggacugaacacauccguucuucgggccguguugccccgcgauauggucuuuagaacuucuaccccuagggugguccuguga

SEQ ID NO: 1772 - RNA, 1710 nt, Artificial Sequence
  derived and/or modified CDS sequence (opt3) from Lassa virus__AIT17365__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccaggcuggucgcgacggggugguccgagugugggauguaaagaaugcagagcuucugaacaaucaguucggaacuaugccuaguuugacccucgccugucugacaaaacaaggccagguugacuuaaacgaugcugugcaggcccugaccgaccucggccuuaucuacacugcgaaguauccaaauacaagcgaccuggauagauugacccaaucucauccgauucuaaacaugaucgacacgaagaaauccucacugaauauaagcggguacaacuuuagucucggagcagccgucaaggcuggugccugcaugcuggauggcgggaacaugcuugaaacuaucaaagugucuccccagaccauggacggcauucugaaguccaucuugaaagugaagaaagcacucggaauguucauuagcgaugcuccuggugagaggaauccauaugaaaacauccuguacaagauauguuuaucgggggacggauggcccuauauugccucucggacauccaucacuggccgugcgugggagaauaccgucguugaucuggagucagacggcaagccucagaaagccgggaguaacggaagcaauaagucccuacagucugcagguuuuacagcuggccucaccuacagccaacugaugacgcuuaaagaugccauguugcagcuggacccaaacgcuaagacuuggauggauauugaagggcgccccgaggacccuguggaaaucgcccucuaccagccaucaaguggaugcuauauccacuucuuuagagagccgacagaccugaaacaguucaagcaagaugcaaaguacucccauggcauugacguaaccgaucuuuuugccgcucagcccggucugacuagcgcggugauagacgcauugccuaggaauauggucaucacaugucaggggucugaugacauucggaaacucuucgaaucacagggccgaaaggauaucaaacugauagacauugccuuaaguaagaccgauagccgcaaauaugagaacgcugugugggaccaauacaaggaucugugccacaugcauacgggaaucguuguggagaagaaaaagagaggcgggaaagaagagaucaccccacacugugcccuaauggacugcauuauguuugaugcagccgucuccggaggucucaauacaucugugcugagggcuguacuuccccgggacaugguuuuccgcacuucgaccccuagaguggucuuguga

SEQ ID NO: 1773 - RNA, 1710 nt, Artificial Sequence
  derived and/or modified CDS sequence (opt3) from Lassa virus__AIT17371__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccaggcuggucgcgacggggugguccgagugugggauguaaagaaugcagagcuucugaacaaucaguucggaacuaugccuaguuugacccucgccugucugacaaaacaaggccagguugacuuaaacgaugcugugcaggcccugaccgaccucggccuuaucuacacugcgaaguauccaaauacaagcgaccuggauagauugacccaaucucauccgauucuaaacaugaucgacacgaagaaauccucacugaauauaagcggguacaacuuuagucucggagcagccgucaaggcuggugccugcaugcuggauggcgggaacaugcuugaaacuaucaaagugucuccccagaccauggacggcauucugaaguccaucuugaaagugaagaaagcacucggaauguucauuagcgaugcuccuggugagaggaauccauaugaaaacauccuguacaagauauguuuaucgggggacggauggcccuauauugccucucggacauccaucacuggccgugcgugggagaauaccgucguugaucuggagucagacggcaagccucagaaagccgggaguaacagcuccaauaagucucuacagagcgcaggauuuacagcuggucucaccuacucacaacugaugacgcuuaaagaugccauguugcagcuggacccaaacgcuaagacuuggauggauauugaaggccgccccgaggacccuguggaaaucgcccucuaccagccaaguuccgggugcuauauccacuucuuuagagagccgacagaccugaaacaguucaagcaagaugcaaaguacagccauggaauugacguaaccgaucuuuuugccgcucagcccggccugacuucugcggugauagacgcauugccuaggaauauggucaucacaugucaggguucagaugacauucggaaacucuucgaaagucaggggcgaaaggauaucaaacugauagacauugccuuaagcaagaccgauucccgcaaauaugagaacgcugugugggaccaauacaaggaucugugccacaugcauacgggcaucguuguggagaagaaaaagagaggaggcaaagaagagaucaccccacacugugcccuaauggacugcauuauguuugaugcagccgucucugggggacucaauacaucggugcugagggcuguacuuccccgggacaugguuuuccgcacuagcaccccuagaguggucuuguga

SEQ ID NO: 1774 - RNA, 1710 nt, Artificial Sequence
  derived and/or modified CDS sequence (opt3) from Lassa virus__AIT17379__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauucggaccucaaaagacugagggaucuuaaccaggccguaaauaaccugguggaguugaagucaacacaacagaaguccguccuccgggugggaacucugacgagugacgaucugcucauauuagcggcugaccuggaaaaacuuaaguccaaaguuacccgcacagagagacccuugucugccgguguguauaugggcaaucugagcucccagcagcuagaucaaaggcgggcacuccugaacaugaucgggaugucaaguggaaaucgcggcgcccaggcuggucgagacggggucgugagaguaugggauguuaagaacgcagagcuucugaauaaccaguucggaacuaugccuagcuugacccucgccugucugacaaaacagggccaaguggacuuaaaugaugcuguccaggcccugaccgaccucggccuuauuuacacugcgaaguauccaaacacaucugaccuggauagguugacccagucccauccgauccuaaauaugguggacacgaagaaaucaagccugaacauuaguggguacaauuuuucucucggagcagccgugaaggcuggugccugcaugcuggauggcgggaacaugcuugaaacuaucaaagucagcccccaaaccauggacggaauacugaaaagcaucuugaagguuaagaaagcacucggcauguucauuucggauacaccuggugagcggaacccauaugaaaauauccuguacaagauuuguuuaucuggggacggauggcccuauaucgcuucccguacuucaauaaccggccgcgccugggagaacacagugguagaucuggagagugacggcaagccucagaaagcggggagcaauaacuccaauaagucucuacagagcgccggauuugcagcuggucucaccuacucacagcugaugacgcuuaaagaugccauguugcaacuggacccaaacgcuaagacuuggauggauauugaaggcagacccgaggacccuguggaaaucgcccucuaccagccaaguuccgggugcuauauucacuucuuuagggagccgacagaccugaaacaguucaagcaggaugcaaaguacagccauggaaucgacgucaccgaucuuuuugccgcucaacccggccugacuucugcggugaucgacgcauugccucggaauaugguuauuacaugucaggguucagaugacauacgaaaacuccuggaaagucaggggcgcaaggauaucaaauuaauugacaucgcccugagcaagaccgauuccagaaaauaugagaacgcugugugggaccaguacaaggaucuaugccacaugcauacgggcauagucguggagaagaaaaagaggggaggcaaagaagagauuaccccacacugugcccucauggacugcaucauguucgaugcagccguaucugggggacugaauacaucgguucuucgggcuguguugccccgcgacauggucuuuagaacuagcaccccuagggugguccuguga

SEQ ID NO: 1775 - RNA, 1710 nt, Artificial Sequence
  derived and/or modified CDS sequence (opt3) from Lassa virus__AIT17381__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauucggaccucaaaagacugagggaucuuaaccaggccguaaauaaccugguggaguugaagucaacacaacagaaguccguccuccgggugggaacucugacgagugacgaucugcucguuuuagcggcugaccuggaaaaacuuaaguccaaagugacccgcacagagagacccuugucugccggugucuauaugggcaaucugagcucccagcagcuagaucaaaggcgggcacuccugucaaugauagggaugaguggaggcaaccagggugcccgcgcugggcgagacggagugguaagaaucugggauguuaagaaugcagagcuucugaacaaucaguucggcacuaugccuagcuugacccucgccugucugacaaaacagggccaaguggacuuaaacgaugucgugcaggcucugaccgaccucgggcuuauuuacacugccaaguauccaaauacaucugaccuggauagguugacccagucccauccgauccuaaacaugauugacacgaagaaaucaagccugaauaucaguggauacaacuuuucucucggugcggcagugaaggccggcgcuugcaugcuggaugggggaaauaugcuugaaacuauaaaagucagcccccaaaccauggacggcauccugaaguccauuuugaaaguuaagaaagcccucgguauguucaucucggauacaccuggggagcggaacccauaugaaaacauucuguacaagaucuguuuaucuggagacggcuggcccuauauagcaucccguacuucaauuaccggccgcgcuugggagaauacaaucguggaucuggagagugacgggaagccucagaaaaccagcaacacgaauagcaacaagucucuacagagcgccggauuugcggccggucucacuuacucacagcugaugacacuuaaagaugcaauguugcaacuggacccaaaugcuaagaccuggauggauauugaaggcagacccgaggacccuguagaaaucgcccucuaccagccaaguuccgggugcuauauccacuucuuuagggagccgacugaccugaaacaguucaagcaggaugcuaaguacagccauggaauugacgugacagaucuuuuugccgcacaacccggccugaccucugccgucauagacgcuuugccucggaacauggugaucacgugucaggguucagaagauauucgaaaacuccuggagagucaggggcgcaaggacaucaaauuaauagauauugcgcugagcaagaccgacuccagaaaauaugagaaugcaguuugggaucaguacaaggaccuaugccacaugcauacaggcguggucguggaaaagaaaaagaaaggaggcaaggaggaaaucacuccacacugugcccucauggauugcaucauguucgacgcugccguaucugggggacugaacaccucgguucuuagggcaguguugccccgggauauggucuuucgcacaagcacuccuagagugguccuguga

SEQ ID NO: 1776 - RNA, 1710 nt, Artificial Sequence
  derived and/or modified CDS sequence (opt3) from Lassa virus__AIT17389__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauggagaccucaaaagacugagggaucuuaaccaagccguaaauaaccugguggaauugaagucgacacagcagaagucaguccuccggguggguacucugacgagcgacgaucugcucauauuagcggcugaccuggagaaacuuaagaguaaaguuacccgcacagaaagacccuuguccgccggcguguauauggggaaucugucuagccagcaacuagaucagaggcgggcacuccugaacaugaucggaauguccggcgguaaucagggggcccgcacuggaaaggacggcgucgugcgaauuugggauguuaaaaacgcugaccuucugaauaaccaguucggcaccaugccuucauugacacucgcaugucugaccaagcaagggcagguagauuuaaaugacgugguccaggcccugacugaccucggacuuaucuacacagcuaaguauccaaacaccagugaucuggacagauugacgcaaagccauccgauucuaaauaugaucgauacuucuaaauccucacugaacauaagcgguuacaauuuuagucucggcgccgcggugaaggcaggggccugcaugcuggacggaggcaacaugcuugagaccaucaaagugucuccccagacaauggaugguauucugaaguccaucuugaaagucaagaaaagccucgggauguucauuucggacacuccuggagagaggaacccauaugaaaauauccuguacaagauauguuuaucuggcgauggcuggcccuauauugcuucccggaccucaaucacagggcgugccugggagaacaccguuguggaccuggaaagugauggaaagccucagaaagcagguagcaauaacuccaauaagucucuacagagcacgggcuuuacugcugggcucacauacucacaacugaugacccuuaaagacgccauguugcagcuggauccaaacgcgaagacuuggauggacauugagggacgccccgaggacccuguagaaaucgcccucuaccagccaaguuccggcugcuauauccacuucuuuagagagccgacagaucugaaacaguucaagcaagacgcaaaguacagccaugguauugaugugaccgaccuuuuugcugcccagcccgggcugacgucugcugucauagauaccuugccuaggaauauggugaucacaugucagggcucagacgauauucggaaacuccuggaaagucagggacgaaaggacaucaaauuaauagauauugcccugagcaagacugacucccgcaaauaugagaacgcaguuugggaucaauacaaggaccuaugccacaugcauaccggcguggucguggaaaagaaaaagagagggggaaaagaggagaucacaccacacugugcccucauggauugcaucauguucgacgcugcgguaucugguggccugaauguuucggugcuuagggcagucuugccccgggacaugguguuucgcacuagcaccccuagagucgugcuguga

SEQ ID NO: 1777 - RNA, 1710 nt, Artificial Sequence
  derived and/or modified CDS sequence (opt3) from Lassa virus__AIT17399__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauucggaccucaaaagacugagggaucuuaaccaagccguaaauaaccugguggaauugaagucaacacagcaaaagagcguccuccgggugggaacucugacgagugacgaucugcucguuuuagcggcugaccuggagaaacuuaaguccaaagugauacgcaccgaaagacccuugucuagcggugucuauaugggcaaucuguccucacagcagcuagaucagaggcgggcccuccugaacaugaucgggaugaguggaggcaaucagggugcacagguggggcgcgacggaguaguucgagugugggaugucaagaacgccgaccuucugaauaaccaauucggcacaaugccuagcuugacucucgcuugucugaccaaacagggccagguggauuuaaaugacgugguccaagcacugacagaccucgggcuuauuuacaccgccaaguauccaaacacuucugaucuggacagauuggcucagucccauccgauccuaaauaugauugauacaaagaaaucaagccugaacaucaguggauacaauuuuucucucggugccgcgguuaaggcaggcgccugcaugcuggacgggggaaacaugcuugagaccauaaaagugacgccccagacuauggauggcauccugaaguccauuuugaaaguaaagaaagcucucgguauguucaucagcgagaccccuggggaaaggaacccauaugagaauauucuguacaagaucuguuuaucgggagacggcuggcccuauauagccucucggacauccauuacuggccgugcaugggaaaacaccguggucgaucuggagucagacgggaagccucagaaagcuggaaauaacaauaguaacaagagccuacaauccgccgguuuuacagcgggccucaccuacucucagcugaugacgcuuaaagauagcauguugcagcuggacccaaaugccaagacuuggauggauaucgaggggcgccccgaagacccuguggagguugcacucuaccagccaucaaguggaugcuauauucacuucuuuagagaaccgacagaccugaaacaauucaagcaggaugcuaaguacucccauggcaucgacgugaccgaucuuuuugccacucagcccggucugacaagcgcugucaucgaggccuugccuaggaacauggugauuaccugucaggggucugacgauauacggaaacuccuggaaucacaaggccgaaaggacaucaaauuaauugauaucgcacugaauaagacggacagucgcaaauaugagaacgccguaugggaucaguacaaggaccuaugccacaugcauaccggaguuguggucgagaagaaaaagagaggcgggaaagaagagauaacaccacacugugcucucauggauugcauuauguucgacgcggcagugagcggaggucugaagacucuugccuugagggcuguccugccccgggauaugguguuucgcaccuccacaccuaaaguugugcucuga

SEQ ID NO: 1778 - RNA, 1710 nt, Artificial Sequence
  derived and/or modified CDS sequence (opt3) from Lassa virus__AIT17405__NP
augagcguguccaaggaggucaaaucuuuccuguggacccagucacucagaagggaacuuaguggcuacugcagcaacaucaagcugcaaguugugaaagacgcccaggcuuuguuacacgggcuggauuuuuccgagguaucuaaugugcagcggcuaaugcgcaagcagaaacgagacgauucggaccucaagcgucugagagaucuuaaccaagcagucaauaaccugguggaauugaagucaacacagcagaaaagcauucucaggguuggaacucugacgagugacgaucugcucaccuuagccgcggaccuggagaaacuuaaguccaaggugauacggacagaacgccccuugucuagcggugucuauaugggcaaucuguccacucagcaacuagagcagagaagggcucuccugaacaugaucgggauggugggaggcgcccaggguacccagccugggcgggauggaguaguucgcgugugggacgucaaaaauccagaucuucugaacaaucaauucggcacaaugccgucauugacccucgcaugucugacuaagcagggccagguggacuuaaacgaugccgugcuggcucucacagaccuugggcugauuuacaccgcaaaguaucccaauaguagcgacuuggaucgacuaucucaaucccauccuauccugaacauggucgacauuaaaaagucaagccucaauaucaguggauacaacuuuucucugggugccgcuguuaaagccggcgcgugcaugcuugaugggggaaauaugcuggagacgauaaaggugacuccacagaccauggacggcaucuugaaauccauucucaagguaaaaagaagccuggguauguucgugucggauacacccggggaaaggaacccuuaugagaacaucuuauacaagauuugucugucuggagacggcuggccauauaucgcaucccggacuucaauagucggccgugccugggaaaauaccacaguggaucuagagagugacgggaagccccagaaaguuggaagcgcugguuccaacaagucucuccagagcgccggcuuuccuaccgggcugacguacucacaacuuaugacuuugaaagauaguaugaugcagcuggacccauccgcaaagacauggauugauaucgagggacgcccggaagaccccguggagauugcucucuaccagccuaugagcggcugcuauauccacuucuuuagagaaccaaccgaccugaaacaguucaagcaagaugccaaguacucucaugguaucgacgucgcggaucuuuuucccgcccagccugggcugacuucagcagugauugaggcuuugccaaggaauaugguacucacaugucagggcagugacgauauaaaacggcuguuagacagccagggacgacgcgauaucaagcugauugacaucgcccuauccaaagcugauucuagaagguucgaaaacgccguuugggaccaaugcaaggaucucugucacaugcauaccggcguggucguggagaaaaagaagcgcgggggaaaagaggaaauaacgccccacugcgcacugauggacuguauuauguaugaugccgcugucucggguggccuuaauaucccgguguugcgggcgguucugccuagagacaugguguuuaggaccagcucccccaagguaguccucuga

SEQ ID NO: 1779 - RNA, 1710 nt, Artificial Sequence
  derived and/or modified CDS sequence (opt3) from Lassa virus__AIT17409__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucaauucucaggguggguacucugacgagcgacgaucugcucaccuuagcggcugaccuggagaaacuuaagaguaagguuauacggacagaacgccccuuguccucuggcguguauauggggaaucugagcacucagcaacuagagcagagaagggcccuccugaacaugaucggaauggucggcggugcacaggggacccagccuggacgggauggcgugguacgcguuugggacgugaaaaauccagaucuucugaacaaucaauucggcacaaugccguccuugacccucgccugucugacuaagcaggggcaggucgacuuaaacgaugcugugcuggcacucacagaccuuggacugauuuacaccgccaaguaucccaauucaagugacuuggaucgacuaagccaaucucauccuauccugaacaugguggacacgaaaaaguccucacucaauauuagcgguuacaacuuuagucugggcgcugccgucaaagcgggggcaugcaugcuugauggaggcaauaugcuggagacuaucaagguuaccccacagacaauggacgguauauugaaaucuauccucaaggugaaaaagucccuggggauguucguaagcgauacucccggagaaagaaacccuuaugagaacauuuuauacaagaucugucugucgggcgacggcuggccauauauugccucuaggaccuccaucguggggcgggcuugggaaaauacaaccgucgaucuagagucagacggaaaaccccagaagguggguacggccggcaguaacaaaagccuccaguccgcaggguuuccuacuggacugacauacucucaacuuaugaccuugaaggauagcaugaugcagcuggacccaucagcuaaaacuuggauagauauugagggccguccggaagaccccguugagaucgcccucuaccagccuaugagugguugcuauauucacuucuuucgcgaaccaacagaccugaagcaguucaagcaagaugcgaaauacucccaugggaucgacgugaccgaucuuuuuagcgcccagcccggccugacgucugcagucaucgaggcuuugccuagaaauauggugcucaccugucagggaucagacgauauuaagaggcuguuagacagucagggccggcgagauauaaaacugaucgacauugcccuaaacaaggcugauagccgcagauucgaaaaugccguaugggaccaaugcaaagaucucugucacaugcauacagggguuguggucgagaagaagaaaaggggagguaaggaggaaaucacuccacacugcgcacugauggacuguauaauguaugaugccgcuguguccggcgggcuuaacauucccgucuugcgggcggugcugccgcgcgacaugguuuuuagaaccucuucgccuaaagugguacucuga

SEQ ID NO: 1780 - RNA, 1710 nt, Artificial Sequence
  derived and/or modified CDS sequence (opt3) from Lassa virus__AIT17413__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugaugcccccggggaaaggaauccuuaugagaacauuuuauacaagaucugucuguccggagacggcuggccauauauugcuucacggaccaguaucgugggccgugccugggaaaacaccacagucgaucuagagagcgacgggaagccccagaaaaugggaaccgcagguuccaauaagucucuccagagcgcuggcuuuccuacggggcugacuuacucacaacuuaugacauugaaagauaguaugaugcagcuggacccauccgccaagaccuggauagauauugagggacgcccggaagaccccguggagaucgcgcucuaccagccuaugagcggcugcuauauucacuucuuuagagaaccaacugaccugaaacaguucaagcaagaugccaaguacucucaugguaucgacguugcagaucuuuuucccgcucagccugggcugacaucagccgugaucgaggcuuugccaaggaacaugguccucaccugucagggcagugacgauauuaaaaagcuguuagacagccagggacggcgagauauaaaacugaucgacauugcccuauccaaggcagauucucgcagauucgaaaaugccgugugggaccaaugcaaagaucucugucacaugcauacgggcguaguuguggagaagaagaaaaggggagggaaggaggaaaucacuccccacugcgcucugauggacuguauaauguaugaugcggcagucucggguggccuuaacauuccgguguugcgggccguccugccucgcgacaugguguuuagaacaagcucccccaaaguugugcucuga

(The sequence listing continues in the following parts.)

The invention claimed is:

1. An mRNA comprising at least one coding region, said coding region encoding a glycoprotein precursor (GPC) of a lassa virus, said coding region comprising a RNA sequence at least about 95% identical to one of SEQ ID NOs: 751-936, 1126-1311, 1501-1686, 1876-2061, 2251-2436, 2626-2811 or 3001-3186, wherein said mRNA comprises a 5' cap, a heterologous 3'-UTR element and Poly-A sequence.

2. The mRNA of claim 1, wherein the lassa virus is from lassa virus clade I.

3. The mRNA of claim 1, wherein the mRNA is a modified mRNA.

4. The mRNA of claim 1, wherein the coding region comprises an RNA sequence as defined by any one of SEQ ID NOs: 751-936, 1126-1311, 1501-1686, 1876-2061, 2251-2436, 2626-2811 or 3001-3186.

5. The mRNA of claim 1, wherein the G/C content of the coding region of the mRNA is increased compared to the G/C content of the corresponding coding sequence of the wild type mRNA, or wherein the C content of the coding region of the mRNA is increased compared to the C content of the corresponding coding sequence of the wild type mRNA, or wherein the codon usage in the coding region of the mRNA is adapted to the human codon usage, or wherein the codon adaptation index (CAI) is increased or maximised in the coding region of the mRNA, wherein the encoded amino acid sequence of the mRNA is not modified compared to the encoded amino acid sequence of an original mRNA encoding the amino acid sequence.

6. The mRNA of claim 1, wherein the mRNA comprises at least one histone stem-loop.

7. The mRNA of claim 6, wherein the at least one histone stem loop comprises a nucleic acid sequence according to SEQ ID NO: 3394.

8. The mRNA of claim 1, wherein the poly(A) sequence comprises 10 to 200 adenosine nucleotides.

9. The mRNA of claim 1, wherein the 3'-UTR element comprises a nucleic acid sequence derived from a 3'-UTR of an alpha-globin gene.

10. The mRNA of claim 1, wherein the mRNA sequence comprises a 5'-UTR element.

11. The mRNA of claim 10, wherein the 5'-UTR element comprises or consists of a nucleic acid sequence which is derived from a 5'-UTR of a TOP gene encoding a ribosomal protein.

12. A composition comprising at least one mRNA of claim 1 and a pharmaceutically acceptable carrier.

13. The composition of claim 12, wherein the at least one mRNA is complexed with one or more cationic or polycationic compounds.

14. The composition of claim 12, wherein the mRNA is complexed or associated with one or more lipids, thereby forming liposomes, lipid nanoparticles and/or lipoplexes.

15. The composition of claim 12, wherein the composition comprises at least one adjuvant.

16. A method of treatment or prophylaxis of lassa infections comprising the steps: 13:
 a) providing a composition according to claim 13; and
 b) administering the composition to an organism.

17. The method of claim 16, wherein the administering the composition is by injection of the composition.

18. The method of claim 17, wherein the injection is an intramuscular injection.

* * * * *

UNITED STATES PATENT AND TRADEMARK OFFICE
CERTIFICATE OF CORRECTION

PATENT NO. : 11,464,847 B2
APPLICATION NO. : 16/471544
DATED : October 11, 2022
INVENTOR(S) : Edith Jasny and Benjamin Petsch Page 1 of 1

It is certified that error appears in the above-identified patent and that said Letters Patent is hereby corrected as shown below:

In the Claims

In Claim 16, Column 131, Line 2, delete "13:".

Signed and Sealed this
Twenty-fourth Day of January, 2023

Katherine Kelly Vidal
*Director of the United States Patent and Trademark Office*